United States Patent 9,782,462 (MODIFIED POLYNUCLEOTIDES FOR THE PRODUCTION OF PROTEINS ASSOCIATED WITH HUMAN DISEASE) - sequence listing, part 3

SEQ ID NO: 1771 - DNA, 3157 bp, Homo sapiens
gtatggtgcctcgctctgggatagctttacggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaattctccaagtcccggctgcttatgtacctatcgagccagattcaccaccgtcattatcaactcattttatgaaaaaatgtaatctaaagtatatccttgttgaaaaaaaacaaattaataaatttaaatcttttcatgaaacattattgaactatgatacatttacagtggaacataatgacctagtgctcttcagacttcactggaaaaatactgaggtgaacttgatgctaaatgatggaaaagagaaatatgaaaaagaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccatttataggattccagagaagactcttaactctactctcaaatgtgaattgcctgtacaactgggatttccacttcttggaacagtagttgaagtcagagatactaatggcttcacaattcaggaaggcagtggccaagtatttttaggtggcagaaacagagtgtgttttcttgatgatgaagtgacagtaccacttggcacaatgcgagctacaggagactttgtgactgtgaaagatggagagattttttttttgggacgaaaagacagtcagatcaaacgtcatggcaaacgtcttaacattgaacttgtgcaacaggttgctgaagagcttcagcaagtggagtcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtggttccagatgaagatgtgacattcaggaagagttgtgccacaaaaaggaaactcagcgacattaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtgtttatgaacttcctggagaagtcttctcttctcctgtggtcctggaatcaatgctcattattgggtgtagagataattatgtttattgtctggatttattgggtggcaatcaaaaataatcaaatacagtccttatttgtataacaaatgtgagatatttgaaaatattttaccattatacatcatgtggacttattttatattaaagaagattatattttggctaag

SEQ ID NO: 1772 - DNA, 3004 bp, Homo sapiens
ggaagatttacgtatggtgcctcgctctgggatagctttacggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaattctccaagtcccggctgcttatgtacctatcgagccagattcaccaccgtcattatcaactcattttatgaaaaaatgtaatctaaagtatatccttgttgaaaaaaaacaaattaataaatttaaatcttttcatgaaacattattgaactatgatacatttacagtggaacataatgacctagtgctcttcagacttcactggaaaaatactgaggtgaacttgatgctaaatgatggaaaagagaaatatgaaaaagaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccatttataggattccagagaagactcttaactctactctcaaatgtgaattgcctgtacaactgggatttccacttcttggaacagtagttgaagtcagagatactaatggcttcacaattcaggaaggcagtggccaagtatttttaggtggcagaaacagagtgtgttttcttgatgatgaagtgacagtaccacttggcacaatgcgagctacaggagactttgtgactgtgaaagatggagagattttttttttgggacgaaaagacagtcagatcaaacgtcatggcaaacgtcttaacattgaacttgtgcaacaggttgctgaagagcttcagcaagtggagtcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtggttccagatgaagatgtgacattcaggaagagttgtgccacaaaaaggaaactcagcgacattaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggtaagtttttgaatttgaggtttgtggagttaaattgaattaccatacaataatcttcataggcccaagttaaattttttaaaaatctaaatatgatgggtttggttgctgtccaaaaattatagttaaccctgtgctgattaatattgtgggccttggggtcaagagtccctggatttgaacctacctgtatagctattatgaactctgtgacctttggcaagttactgaacctcttagaatttcactttccttgtgggtaaaatgggaataataataaaatgtgttgctgtatcacaaataccccaaaactcaacaacctagaacaacacaaa

SEQ ID NO: 1773 - DNA, 3241 bp, Homo sapiens
ccgcgacgagctatccgggaaagggccgaatgcgatcaaacctaatccgcgagacttgctaaaattctccaagtcccggctgcttatgtacctatcgagccagattcaccaccgtcattatcaactcattttatgaaaaaatgtaatctaaagtatatccttgttgaaaaaaaacaaattaataaatttaaatcttttcatgaaacattattgaactatgatacatttacagtggaacataatgacctagtgctcttcagacttcactggaaaaatactgaggtgaacttgatgctaaatgatggaaaagagaaatatgaaaaagaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccatttataggattccagagaagactcttaactctactctcaaatgtgaattgcctgtacaactgggatttccacttcttggaacagtagttgaagtcagagatactaatggcttcacaattcaggaaggcagtggccaagtatttttaggtggcagaaacagagtgtgttttcttgatgatgaagtgacagtaccacttggcacaatgcgagctacaggagactttgtgactgtgaaagatggagagattttttttttgggacgaaaagacagtcagatcaaacgtcatggcaaacgtcttaacattgaacttgtgcaacaggttgctgaagagcttcagcaagtggagtcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtggttccagatgaagatgtgacattcaggaagagttgtgccacaaaaaggaaactcagcgacattaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggctgttataatggattagtttatgttctgaaaagtaatagtggagaaaaatactggatgtttactactgaagatgctgtcaaaagctcggcaaccatggatccaaccacaggactcatttacattggatctcatgaccagcacgcatatgctttagatatttatagaaagaagtgtgtttggaagtcaaaatgtggaggaactgtcttttcctctccgtgtttgaacctgattccacatcatttgtattttgctacattgggaggacttttactggctgtaaatcctgctactgggaacgttatttggaaacattcctgtggaaaaccactcttctcttccccacaatgttgctcacagtatatttgtattggctgtgtagatgggaatttactctgctttactcactttggagaacaggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtgtttatgaacttcctggagaagtcttctcttctcctgtggtcctggaatcaatgctcattattgggtgtagagataattatgtttattgtctggatttattgggtggcaatcaaaaataatcaaatacagtccttatttgtataacaaatgtgagatatttgaaaatattttaccattatacatcatgtggacttattttatattaaagaagattatattttggctaagaaa

SEQ ID NO: 1774 - DNA, 3233 bp, Homo sapiens
cctcagatttctcaggagaccagaactgatctgccagccttgctgccttttgttgctctgctctttacattgtctttacagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatgatcatgctatttgttaatttattgtgccactttttttcttttgttttttttttgttgttgttgttttttgagatggagtctcgctctgtcacccaggctggagtgcagtg

SEQ ID NO: 1775 - DNA, 3163 bp, Homo sapiens
aaacacctcctacttcccggccttccatcccagtttcttctaggaattcggagcctcccctgcagcgactcggaagattcgaggcggcgggggacaagtcggcgccccagagcggacgagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatga

SEQ ID NO: 1776 - DNA, 1329 bp, Homo sapiens
agattgtgctgtgcgcctgaagccctggcggtgcagccgtgcacggagtcccgtggagcgtttgtttgggctggattatcccgctgcagccgaggttgggggcccgggttcggggctccgcacctcttctctggggttcaccctctcggataccgcctgggcagactccatcgatgcagaacccgagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacgtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctcctgagtgaaaacggagcattccgggctgaggagagccgccagcggctggctgaggtggcattggcgtatgccaaggcaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgctcacatgcta

SEQ ID NO: 1777 - DNA, 3173 bp, Homo sapiens
gggggcggaccgtggggaagctgcttccgggtgagccccccccgctcttacgcggtctgtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctcctgagtgaaaacggagcattccgggctgaggagagccgccagcggctggctgaggtggcattggcgtatgccaaggcaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgctcacatgctagcggggcccagcagccctgggtggttttgccagcatgctaactcttgtaactcgcagctgcatcctatgagctctcccaagcttccccgcccctcccctgggtcagccgtgaggcccacctttgccaccctcagctctttcctctggtgtggcttcagcttgaaagcaacctggagtcgggggcacagcctttggggcctggctgggagagggtcttggagcattaggggaagaagagagcagtgggatcttggggcctgagaagccttggaacgcttctggcagcagagctgggtgtgggaatgaggcctagatcgatatccctgggttagagttgaaatttgccgcaattccactggaaggcatttcccacgaggccagaggttgccaggctgcctgaggtctcctattctactctgaaccataaacccagagaagaattactcattaaccagcataaatactgcctgaggatcaaaactcagaggcaaagagggagttcctgactgctagaggtgccaccaccacaaacactttttattcaggagatactttttgagaatctctgctctgttcctaggttcagtgctgggtcctgggaatacagcaggacagacctcagcttatctcttcatagaaattatacaaagagaattggggagacagctaagaagaaaacaaagaaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaggagttgtgcaaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattgtggatgtgtttagaaggtagattcgatgtgaaggatgaatctggcttgaccttctgggtggctgatgggccatttactgagatggggcagcctggaagaggaacagaagcagggtcggggtggagggagaatactaaacttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttgtaaagaattttgaataaaaattcaatatttgaa

SEQ ID NO: 1778 - DNA, 703 bp, Homo sapiens
acctcctctccaagcccagctccccactgccctcttcctgccctgtccctgtctccgctgccctttagatcaggcaggcaggcaggcctagagcatccgccctgagacactgcctgttggctgccttaagacgccccttccttctctgcccgcagcctccccagcctctgcattcctctgcttcctgtctgctctgctcagcctgcaggattgatcttcccaaagccaggtgtcaaccaggccactaaccctacccactgctcagaaatcttcccacagcctcagcctggccccctcttatccatcccctccatacacacttgcctcagctcctcaaaacagtccacagccatcctccttccccacctttgcccctttcttcccttcctaaggaaatattggcccccttctctccaccaggctgaacccactcatcctgcaaaaccaagttcaacgccctgtcattttcttttttttttttttttttgagatggagtctcacactgtcgcccaggctagagtgcaatgggtgcactctcggctcactgcaacctctgcctcctaggttcaatcgattcttctgcctcagcctccagaggaactctgactacagacagagcctgcagccaatgccccaggagccctcggttccaaccaactgatgcccctgtgcccactggcccacgccatgcagccccagtcc

SEQ ID NO: 1779 - DNA, 536 bp, Homo sapiens
gctcttacgcggtctgtgggagaccggagcgggagacagcggtgacaggagcagcggccgggagcccttagggaggcagcacccaaagcagaaacagtatgggcagagagacgcctactgaatcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagacctt

SEQ ID NO: 1780 - DNA, 583 bp, Homo sapiens
aggaagactggataaaatgggcccctgagatggctgaaggcagctaaaggggcctaagagactatggggagaagggcagccagttcctaggcagccctgccccactgtttctgataagcaggaggcagttgttccctcagcctcctgaaagcaatgaggagttgaggccacgggaatgcagctttggattccagaagccaaggacctgttacaaaggtggttttctgggaagcaaattagagggattagacctggcttcgacatctgacttgactccaacctaccaaaggatctcccagttcacctgggagttaacacaccagggttctagtccttttgctcgctgtgtggctttggacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcc

SEQ ID NO: 1781 - DNA, 2212 bp, Homo sapiens
atattaaggcgccggcgatcgcggcctgaggctgctcccggacaagggcaacgagcgtttcgtttggacttctcgacttgagtgcccgcctccttcgccgccgcctctgcagtcctcagcgcaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatg

SEQ ID NO: 1782 - DNA, 2430 bp, Homo sapiens
agcgcccaaggcgcatgcgcagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagatgagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtg

SEQ ID NO: 1783 - DNA, 2406 bp, Homo sapiens
ctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtg

SEQ ID NO: 1784 - DNA, 2125 bp, Homo sapiens
aagaaggcagcgcccaaggcgcatgcgcagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctga

SEQ ID NO: 1785 - DNA, 2356 bp, Homo sapiens
cggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaa

SEQ ID NO: 1786 - DNA, 2027 bp, Homo sapiens
aatgcagggccaggccggcagaaggcagggtgggtggggctgagtcagaggagaagggataaatgccaggtcctaacccaagtacccacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 1787 - DNA, 1795 bp, Homo sapiens
acctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctg

SEQ ID NO: 1788 - DNA, 1936 bp, Homo sapiens
acctgtcattcgttcgtcctcagtgcagggcaacagggcccacatgccttggccccacataccaacccaggctgctgtgacagcccatgagagggggagaggttgctctgggatggaacaagaaaaagaggttgttttgtgaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 1789 - DNA, 664 bp, Homo sapiens
acctgtcattcgttcgtcctcagtgcagggcaacagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggc

SEQ ID NO: 1790 - DNA, 2276 bp, Homo sapiens
agacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcc

SEQ ID NO: 1791 - DNA, 1955 bp, Homo sapiens
gagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 1792 - DNA, 1719 bp, Homo sapiens
ggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 1793 - DNA, 1860 bp, Homo sapiens
gcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcc

SEQ ID NO: 1794 - DNA, 2033 bp, Homo sapiens
gagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcc

SEQ ID NO: 1795 - DNA, 1123 bp, Homo sapiens
gatgcagagggctgtaagtgtggtggcccgtctgggctttcgcctgcaggcattccccccggccttgtgtcgtccacttagttgcgcacagtggtccactccttggctttgtttgctgtgaactggattccaaggacagccttctcagaagagctagagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctca

SEQ ID NO: 1796 - DNA, 4353 bp, Homo sapiens
gggcgcgcccggccggcggggccgcgcacgcagccgccgccaccacttccccctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaatagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactga

SEQ ID NO: 1797 - DNA, 2238 bp, Homo sapiens
tcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttgttcattttatgcgtgcgagaagtcagtggtaactgctgcagggcttaatacattagtggtaactggtttaaaaaacaaagactgtaagcctgtgtgtgccactgtttgcttcaacagtatatcctaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtg

SEQ ID NO: 1798 - DNA, 2823 bp, Homo sapiens
cctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgagaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagc

SEQ ID NO: 1799 - DNA, 1743 bp, Homo sapiens
tggagcagcggggcctggcacacagtaggcgttctataaatgtgtcacaagaatggcttccctcaggaaggcggcattaccgctgcctttctgcagaaaaggaaactaaggctcagcaagaaccaccgcccagccagagccaaggtcacagagcacgtccgtggcacgcgtccaggtcgtgccacagcagggccggcggcttcgacgcgggcagccgggtcccttttctttgacagatggggaaaccgaggcccggccggctgccggggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttc

SEQ ID NO: 1800 - DNA, 1676 bp, Homo sapiens
cgggcgcgcggggagggggcgcaggaagcgggcgaggccgggcgcgggaggcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttc

SEQ ID NO: 1801 - DNA, 1907 bp, Homo sapiens
gtctcctggtggggtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccggacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccctgggcggccgctgcccccaggccgcctgccacagcgccctccggccccaggggcagtgctgtgacctctgtggagccgttgtgttgctgacccacggccccgcatttgacctggagcggtaccgggcgcggatactggacaccttcctgggtctgcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgcccctgccgcggcggctcagcctggttccgaaggcggccgcagacagcaccagccacagttacttcgtcaaccctctgttcgccggggccgaggccgaggcctgagcggccgcctgaccgtcgaccttggggctctccacccgctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 1802 - DNA, 3145 bp, Homo sapiens
cccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccggcttctggtggttcatttaatggattcacacagccccaggatacttcattattcacaatgcagacagaccagagtatgatctgcaacttgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaa

SEQ ID NO: 1803 - DNA, 3665 bp, Homo sapiens
cccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacacatacatttaatgatgatataactgactcttcagaaagtctttccttgtgtaacctgatcatggaggaaactccagacagtgggttggccgaagaaattcaaagatctcaaaatgatataggtgcatttacttggggccctgacgctagtacagacagggtcagccaagaagttacctcaggtgggtttggagaagactctgcatgtccctccgaaacagagcaagacataagattatccaccagcctgctttcgtctgctgactggcccactgtagctgaagagagtgagcatgccccggggccagcctttccaggtggaaatgaacaactgcccccaaagcctgcgccggaggctggagttgccattgctgcttgtgtggagatggagcagctgtatgacccacttgactcagacatgccagccatggacacagctggcctgttcaaagaaagtcatgaagatatgaagaagtcagatgaagaggaagagaaacagaagatggaagattctctgtgggcaggtgtggaggcgtgtcaaaaggcttctggtggttcatttaatggattcacacagccccaggatacttcattattcacaatgcagacagaccagagtatgatctgcaacttgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccct

SEQ ID NO: 1804 - DNA, 3418 bp, Homo sapiens
cagtcccgacgcatcccgcccccgctctgtcgctttaagctggtcccgccgccgcgccccgccctcacccctccgcgctccgcggctccccgccgcttctcccgctcctcccttgctcggccctctcctcctcctcccgctcctcctcccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccggcttctggtggttcatttaatggattcacacagccccaggatacttcattattcacaatgcagacagaccagagtatgatctgcaacttggctgaatctgaacaggctccacccacagagccaaaagcagaggagcctctggctgctgtcacacctgccgttggtctggaccttggaatggacactcgggctgaggagccagtggaggaggcagtgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaa

SEQ ID NO: 1805 - DNA, 1064 bp, Homo sapiens
gtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccgactgactcttcagaaagtctttccttgtgtaacctgatcatggaggaaactccagacagtgggttggccgaagaaattcaaagatctcaaaatgatataggtgcatttacttggggccctgacgctagtacagacagggtcagccaagaagttacctcaggtgggtttggagaagactctgcatgtccctccgaaacagagcaagacataagattatccaccagcctgctttcgtctgctgactggcccactgtagctgaagagagtgagcatgccccggggccagcctttccaggtggaaatgaacaactgcccccaaagcctgcgccggaggctggagttgccattgctgcttgtgtggagatggagcagctgtatgacccacttgactcagacatgccagccatggacacagctggcctgttcaaagaaagtcatgaagatatgaagaagtcagatgaagaggaagagaaacagaagatggaagattctctgtgggcaggtgtggaggcgtgtcaaaaggcttctggtggttcatttaatggattcacacagccccaggatacttcattattcacaatgcagacagaccagagtatgatctgcaacttggaaatcacagtgaactga

SEQ ID NO: 1806 - DNA, 3143 bp, Homo sapiens
cccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacggcaggtgtggaggcgtgtcaaaaggcttctggtggttcatttaatggattcacacagccccaggatacttcattattcacaatgcagacagaccagagtatgatctgcaacttgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccct

SEQ ID NO: 1807 - DNA, 1224 bp, Homo sapiens
cccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagacagtaccttgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacagtgggttgg

SEQ ID NO: 1808 - DNA, 969 bp, Homo sapiens
agacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataa

SEQ ID NO: 1809 - DNA, 1240 bp, Homo sapiens
acagacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacaga

SEQ ID NO: 1810 - DNA, 1787 bp, Homo sapiens
gatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagca

SEQ ID NO: 1811 - DNA, 403 bp, Homo sapiens
gctgttatgtgagaacattaggccacagcaacatgtcattgtgaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggg

SEQ ID NO: 1812 - DNA, 1363 bp, Homo sapiens
atgcacccgtggtcagggagaaacagaatatggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttg

SEQ ID NO: 1813 - DNA, 1862 bp, Homo sapiens
tggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagca

SEQ ID NO: 1814 - DNA, 1787 bp, Homo sapiens
tctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaata

SEQ ID NO: 1815 - DNA, 403 bp, Homo sapiens; identical to SEQ ID NO: 1811

SEQ ID NO: 1816 - DNA, 1363 bp, Homo sapiens
atgcacccgtggtcagggagaaacagaatacggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttg

SEQ ID NO: 1817 - DNA, 1632 bp, Homo sapiens
aaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaa

SEQ ID NO: 1818 - DNA, 1634 bp, Homo sapiens
aaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaata

SEQ ID NO: 1819 - DNA, 2181 bp, Homo sapiens
ggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaa

SEQ ID NO: 1820 - DNA, 832 bp, Homo sapiens
gagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtgttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaac

SEQ ID NO: 1821 - DNA, 869 bp, Homo sapiens
caccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaa

SEQ ID NO: 1822 - DNA, 3467 bp, Homo sapiens
cagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 1823 - DNA, 3355 bp, Homo sapiens
agtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 1824 - DNA, 3167 bp, Homo sapiens
gcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 1825 - DNA, 3543 bp, Homo sapiens
cgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 1826 - DNA, 3578 bp, Homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagc

SEQ ID NO: 1827 - DNA, 3464 bp, Homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagc

SEQ ID NO: 1828 - DNA, 2517 bp, Homo sapiens
cagcagcgcactcggtgccccgcgcagggtcgcgatgctgcccggtttggcactgctcctgctggccgcctggacggctcgggcgctggaggtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattct

SEQ ID NO: 1829 - DNA, 2737 bp, Homo sapiens
agtgttgacatgctgttgactcaccctcccgaggatggaagctctggcctgggtcaagttgtggtcactgcagttaacagtttgttgatctcagggagtattccacagttgctgatgtaattgacaatgattggagccagctcttccccagattcaaatggaccaattagaggacttgttggttctgtttatcaactatgtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattctt

SEQ ID NO: 1830 - DNA, 2518 bp, Homo sapiens
gtcggatgattcaagctcacggggacgagcaggagcgctctcgacttttctagagcctcagcgtcctaggactcacctttccctgatcctgcaccgtccctctcctggccccagactctccctcccactgttcacgaagcccaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtgg

SEQ ID NO: 1831 - DNA, 1385 bp, Homo sapiens
gatgttgtgatggagaagccgcggcggagcccgaaccccgcagcctgagccacctccgtcatctgggcccggggcctcaccgcgcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagggactttgcctacgtagctcgtgataagctgacccagatgctcaagtgccacgtgtttcgctgtgaggcacctgccaagaacatcgccaccagcctgcatgagatctgctctaaggcacggccccctccactccctggactagttgccacctttgctctacaagggtgtgggtggggtcactgagtgctgtaggggggccccagggcaatgaggctctaatagattctccctggctcctcgcctcccttccttcctcagatcatggccgaacggcgtaatgcccgctgcttggtaaatggactctccctggaccactctaaacttgtggatgtccctttccaaggtcagtgtcaaaacccctccaggtccagctcagctttgttggcaaaggtgggtgacccaaggaaaggcatgagctcctggacagcgctgatagaaaaatgaacacatgaagactgaatactccaatacgtggagggactccggttaaagggaggcaggggacgagatgaaagtagggcctcggctgggcaagtgtccagcttatgccctgctggtggggctgcgggtgagcaaggtctgccaccatgatcaaccttctcttctttcccatagtggaattcccagcgcctaaga

SEQ ID NO: 1832 - DNA, 1810 bp, Homo sapiens
ggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtgacagccccatctctgcccctgctagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgac

SEQ ID NO: 1833 - DNA, 3635 bp, Homo sapiens
cagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatg

SEQ ID NO: 1834 - DNA, 3599 bp, Homo sapiens
cagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatg

SEQ ID NO: 1835 - DNA, 554 bp, Homo sapiens
cagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaagaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccagg

SEQ ID NO: 1836 - DNA, 3635 bp, Homo sapiens; identical to SEQ ID NO: 1833

SEQ ID NO: 1837 - DNA, 3349 bp, Homo sapiens
gcccggcagccgcaggccggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccaggcggagggagctgttcatcctctgggggctgctgggccagaaatatctcttacctgataatgtcaggcatcagaggttcctgtttcgtggtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaa

SEQ ID NO: 1838 - DNA, 936 bp, Homo sapiens
agtggtgagcacggtgtcgggggccgcattagctattgatttatgtgctgttatagaattaattgagtctggacatggagactcattttcttggacatgtagcagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggc

SEQ ID NO: 1839 - DNA, 4031 bp, Homo sapiens
agtgtgcccggcgcgggtgaggcggaagcggccggggcgggggcgcaggcccggcagccgcaggccggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccaggcggagggagctgttcatcctctgggggctgctgggccagaaatatctcttacctgataatgtcaggcatcagaggttcctgtttcgtggtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaa

SEQ ID NO: 1840 - DNA, 535 bp, Homo sapiens
aacaaccgctgacttcctggttcctgggtgccgcatcactgcccctctgctccgggtcaaaccggctgtatgcttagcttcaggaacatgtggcaggtggcagcccccggccccgtggcagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggg

SEQ ID NO: 1841 - DNA, 594 bp, Homo sapiens
agcagtcgcggtgtgcggctcggcgcgggctcacaaagagctcggcctcgcggactgagccggcggcagcggggcggggacggcggcgtacccgggcagcccagcgccctggccaggcgtgcctgtgcttaatcagcactgacgactggtgctgcttcagttgatttgatacacctagaggcagcctcatctccaacttgccttgacttcgtctggggagctgccgtgggggacccctggactggcagcattcccacccctcactttggcaaccctggtctaactccgcggagggagctgttcatcctctgggggctgctgggccagaaatatctcttacctgataatgtcaggcatcagaggttcctgtttcgtggtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccgga

SEQ ID NO: 1842 - DNA, 711 bp, Homo sapiens
gcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttgaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagag

SEQ ID NO: 1843 - DNA, 3138 bp, Homo sapiens
acataacagtaaggcaagaagatgactgcatttatcttctcagaatcacttcttcttaattgttgcttcccactattggcattggtgaaaggctgggccacaggaggctggatgaactttgtgttagccagtctcctgaatatttacgcgttgctgaatctcctgtggacaaaccaccaataggccaggactgtcctgtggacagacgggaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaa

SEQ ID NO: 1844 - DNA, 2636 bp, Homo sapiens
atgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 1845 - DNA, 2619 bp, Homo sapiens
tcgggctccagccccgtccgcgcgtctcccggcgtgggtgcgggaccagggcgctgcggggcgcgcagggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 1846 - DNA, 2642 bp, Homo sapiens
atgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagcaacagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 1847 - DNA, 2128 bp, Homo sapiens
gagacgctgcagcctagctgggccctggcaggtgaggggtggggggtggtgctgggaagccccaagcccagcctcaagcttgctggggctcaggacctcaaagcccacccttgggttcaaactgctgtgcaggtcctggacaggggcgggatccctgaaggccttgaaaccacaccctatttatgctgacagctataggctctgcagggccccaggcagctggggtattccttaggggctgagtctcctggtatccctaagactgggcttggcttaggcactgaggactttttcctggccattatcctgcaggacagcagcgcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagcaacagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaat

SEQ ID NO: 1848 - DNA, 2089 bp, Homo sapiens
atgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagcaacagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 1849 - DNA, 1569 bp, Homo sapiens
gttggagtggtgtggctctgccggcagacaagggtgtatgacacagatgcgagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagcaacagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctccc

SEQ ID NO: 1850 - DNA, 8972 bp, Homo sapiens
gccaaagcctggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcctcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttta

SEQ ID NO: 1851 - DNA, 8338 bp, Homo sapiens
tcacactgtataccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcctcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttt

SEQ ID NO: 1852 - DNA, 1681 bp, Homo sapiens
aacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatc

SEQ ID NO: 1853 - DNA, 544 bp, Homo sapiens
gatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagtctcactctgtcaccaggctggagtgcagtgacgtgatctcggctcacagcaaccgctgtctgccaggttcaagtgattctcctgcctcagcctctcgagtaactggaactacagatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggt

SEQ ID NO: 1854 - DNA, 1274 bp, Homo sapiens
aacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcagagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgat

SEQ ID NO: 1855 - DNA, 3316 bp, Homo sapiens
aaagcctggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaa

SEQ ID NO: 1856 - DNA, 3592 bp, Homo sapiens
gcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagcagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcat

SEQ ID NO: 1857 - DNA, 604 bp, Homo sapiens
ggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggtgttgacaccttggcagtgtttatggccagcagcggaactacagacgtcacaa

SEQ ID NO: 1858 - DNA, 639 bp, Homo sapiens
ctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaa

SEQ ID NO: 1859 - DNA, 4166 bp, Homo sapiens
ctggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttata

SEQ ID NO: 1860 - DNA, 2964 bp, Homo sapiens
tgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagcagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtggga

SEQ ID NO: 1861 - DNA, 6992 bp, Homo sapiens
aacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcaggcacagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcctcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttt

SEQ ID NO: 1862 - DNA, 1804 bp, Homo sapiens
ggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgccccatctctgcccctgctagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgac

SEQ ID NO: 1863 - DNA, 2218 bp, Homo sapiens
acgtgaccccctcccgtcgagtctcaggctgcgtgtgagcgcactcacgaccggggcgcgatgatctcactcgtgcgcgagtgcgcgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtgacagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgac

SEQ ID NO: 1864 - DNA, 1748 bp, Homo sapiens
ggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtgacagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctc

SEQ ID NO: 1865 - DNA, 1455 bp, Homo sapiens
atgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaa

SEQ ID NO: 1866 - DNA, 1920 bp, Homo sapiens
atgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgac

SEQ ID NO: 1867 - DNA, 2032 bp, Homo sapiens
gtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccggtgaggatgcctacatcccccaagcaagagctacttctccctcccggctgcaggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacaggtgagtgaaaaccaggtatcctgagccccatccctgatgtccctactccatccctgctatatccctagcctgactttccagcctcctgcaggctcctgcctctaaccagcttctaccccagccccatctctgcccctgctagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgta

SEQ ID NO: 1868 - DNA, 2020 bp, Homo sapiens
ggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctc

SEQ ID NO: 1869 - DNA, 2450 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgcagacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 1870 - DNA, 1929 bp, Homo sapiens
ggtctctgatgcttgcatccttggaaaaggacaaaactgccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagca

SEQ ID NO: 1871 - DNA, 3720 bp, Homo sapiens
gtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcc

SEQ ID NO: 1872 - DNA, 3687 bp, Homo sapiens
tttgttgccaggtggacgcggccccggccttcgcgcgcggcagggatgctgcgagccccgggggagctcccgcgccaggccgcccgctgctccctctgccgcctggggccgggtcgcggacgcgcattttttaagtggcgctgtttgcctgcgtccgtagaccgaggaaacccgctctgggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcc

SEQ ID NO: 1873 - DNA, 3270 bp, Homo sapiens
gcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaagga

SEQ ID NO: 1874 - DNA, 1862 bp, Homo sapiens
gctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaa

SEQ ID NO: 1875 - DNA, 2530 bp, Homo sapiens
agatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataataga

SEQ ID NO: 1876 - DNA, 560 bp, Homo sapiens
agatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgagtcttctcagatctgttgcagtccccggtctttcctgatcagcaccctcaaatgtctcattgtggatgagattaatgctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtct

SEQ ID NO: 1877 - DNA, 556 bp, Homo sapiens
agatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattgg

SEQ ID NO: 1878 - DNA, 1984 bp, Homo sapiens
agatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgagtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgcc

SEQ ID NO: 1879 - DNA, 3687 bp, Homo sapiens; identical to SEQ ID NO: 1872

SEQ ID NO: 1880 - DNA, 6468 bp, Homo sapiens
gagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacgggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttacttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcagacggagtttcgctcttgttgcccaggctgggagggcaatggcaccgtcttggctcactgcaacctccgcctcccgggttccagcgattctcctgcctcagccttccgagtagctgggattacaggctcctgccaccacgcctggctaggaaattttttgttgttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgc

SEQ ID NO: 1881 - DNA, 6644 bp, Homo sapiens
aagcgcatctcaggactgatagctccgccctaaactaagggagagactgtgctcccaagtacgtagcctgcagtgcctaacgcattctcagcaattttgacccccaacagacgccgtcgacagtctcccaagaacaattcccaggagctcggattccaagagccgcccgcgccctcgtttaccttcgctagtcgccctgcagccccgccctgtccggaggccccgccctccatgaatcagctgatcccgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaagggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatccccagcctggtgttgttcttccctatacttcacactgaactcaggatgggaagaaaaaggaaacaagctttggctttttccatctcaaaagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatcttt

SEQ ID NO: 1882 - DNA, 571 bp, Homo sapiens
aagctcgcgccggatgcggagcgcggtgctgccggtggagcttcagcttatgtcttgatgtttgcctgcatgtagctgaactgattgatccaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattg

SEQ ID NO: 1883 - DNA, 559 bp, Homo sapiens
agctgatcccgcggacccactgggttgccaagctcgcgccggatgcggagcgcggtgctgccggtggagcttcaggatggagaaggaactgactgctgtacccaagtgaagatctttactcagttacccttatatttggctatatggaataaaattgtgtgatatgtttattctgagcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtga

SEQ ID NO: 1884 - DNA, 3242 bp, Homo sapiens
tttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaaggataattctggcctcatagaacaagttgggaagtgttccctcctcccctattttctgaaagtttgcgaagctttggtattatttcttctttgaatgtttgggagaattcaccaatgaagtcttctgggcctaagcattactttggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccag

SEQ ID NO: 1885 - DNA, 3242 bp, Homo sapiens; identical to SEQ ID NO: 1884

SEQ ID NO: 1886 - DNA, 2674 bp, Homo sapiens
gaatcagctgatcccgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcaggtacctgctcaattttataaaataaaagtgtgtctagagttgaactgtatgggcttttctttagaaactttaaaatgagtaaggcttggtagcattttttattttttgagtttgattataattttgttttatcaggcaagcctagataaaggaaagaacctggattaattcaaaatcactctttatgtttgttctggccctttatgatattgaaaggtgtcatgttgggcttgttttataagtaggagcatttcatttttttttcttgctagtactttttttctatggctaaagtactgaattttggtgggccctgaatagtttaatataactagagattcacaaagattcttcttacttgtgtttgtaacactcttcagaattctgtagagaaaagtcttttccttctttaacagggaagattgttttgtggcagatccttcaattgtaggcagatttaaaacttacaggcaattacatgtttcagtttttttcaattatagctgtggtccttactgggcttaatttgaagaggtggctaatattttatctttttgtttgtttgtttttgagatggggtcttgctctgtcacccaggctggagtgcagtaatgcgattgtggctcactgcagcctcgatctcccaggttcaagcgatcctcccatttcagccttccaagtagctgggactatacacatgccaccacacctgctgattttatttttaagtagagtagagcctgttgcccaggctcatctcaaactcctgagctcaagcaatcctcccacctcagcctcccaaagtgttgagattacaggcatgagccatcatgcccagcctattttatatatcttattaaaactattttcattttgaagatttgtggtagaatgaacaaaagttgtttatcagtagcacatggtaaagtttgagttcccgcttaaactaaattgttttaaaaggattatttctgtgttttactcttagtgtggccttttgattttgctttaccaaaactgtaagaaaacaaaacaaaagatcatactcataaaagatctgtcctgcagtgtttctttttaggtttttgaaaccacatagcctcttgattctcaattcttattgtttactctgtcagaatgtgaacatgaaggtatttttagaaatagtctttatttcacaatctattcactgaaacttgtgggtatttgaatttttaaaaaaatcaaggataagctgtttggagaaaggtattataaagtctgaacaaagcaaaagtagtagtttaacaagaatgcatgtagaaaattcttagactgtacatgcttatcacattttacttactttgttaaacattggaagtttttgttacttatgctagtaacaatgtgtgtgtttctattgaattaaatttaatttattt

SEQ ID NO: 1887 - DNA, 5934 bp, Homo sapiens
atcggcggcggcaggactgggggagtcagaggtctggcagcgctgtctgcgcagacctaccggacgctacctcccaaccccccgtcttcctcctgcctcctcctcctcccgtcacctcctgacccgccggagctccgagcaactgccggcctccgcccccagccgcagccggtcactggcggcgccttccgcgccaagcttgggggccttttcggggtcccacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggcctgtgtattgttctcaatggtcccaagaattactctaatatagttgtttttctgagggaggatggatggagataactatcctgatcccaatgtcactttttaaggcattcgcttcaagagacaagcagtttagaatcaggcagaactggattgcaaaatttatgggcagaccgagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtaattttttttaactaattgaaagtaacaactttattttaaaaagttaactattatctattacatgtttaaaaagtcaaattaccctttgtatataggtgctttgttctatttatgtttatcagttggaaaaaacataagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatgtatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatctgtggaaactgtgcagttgcattttagcctcttcccttccaatttttgtacttttaactacaaaccagtagtatactaatggttatctaatagaaatttaaagtgtcttggtaagtactgagaatttttacttgaattaatcagataagcaacagaaatcaacatatgtagcatggatttgtgctatattggaagtaaaacactataggcagaaagatgtagaaattaagagaattgaaaaagaataatagaattccttggtgtttacagataatttggaaaactttttgatgacagcagaggattttttcccccttattttgtaatgaagatccagcactggttaaaaaataatttgatttgtagttacatttttctatgccagagctcttactgaattgatgatattaggatttctagtattttaaggtaagtatttatagtttaaaatttagtttatatttaaaactttaaaacatctgatctgggatttttttgttaagtaagtatattaacttcaaataccaaattactactaagcagtatattgattataagcatctgttgtctaaagattggtactaggctggacatggtggctcacacctgtaatcacaatactttgggaggctgaggtgggtagataacctgaggtcaggagttcgagaccagcctggccaacgtggtgaaaccctgtttctactaaaaatacaaaaattagctgggtgtggtggtgggcacctgtaatcccagctacttgggaggctaaggcaggagaatcgcttgaacaccggaggcggaggttgcaatgagccgagatcgcgccattgcactccagcctgggtgacaagagaaaaactccatctcaaaaaaaaaaaaaagattggtaaactagaaatatcaactataattgtcaggaaattaacctaaaggcttttgtttctccagagaccatttgtgggtatattttatattttaaaaataaagattttaaatggatatcaatgtttaatattcaaaacatgcacaatataatatcaaatttaaccttaatactttacatgaatatgagtcacttttggcttttctaagtccagcctcccattcttaattgacttggtttcaggtacatgacatgtatctaaatataaagtactgttatagtagaggtaggtggaattctaatattccctgctctttagatttatattttatttaatataaagtttattatttataccctttttaatgcaaagctaatatttagttatatgtatgatttttaataaaaattactttactttttcctatgaatttaaaacatttgatgttggcattttatacaggcaggttgccaaatttaattatgttacactaagttaaacacagcacttaattacctcaaatccagatttctcttaatctgtgtgtacataaaaggaataagtccaaattaatttatagtttagtgttgcactataggtaatattcttttgttatttctagtttttatggaatccttttctttcaagattctaaataataaatcgttacgtctcaatagtggtaatagtggtaatggtttattattagctgtttcaccaattgaactacattcttttggagacattcctttcttttttgatgttgatttgcaaaggagaaatgcttgttaatatacaaactctagtcagttacctgtgaggatgagatgtgtcagaggactcagactttggtatagttagaaaaataatatttttctcacttgattctgtgtgaatgtctcttctgatactgttttttaatcagaaagttacagagcaactttcccacaaacaaaccaataaaacaaaaccccacaaaaaccaagagcatgaagaaaagtttaaatccctaattatatactcttttggtttttaggtagaaactggagctatcaatattttcatgtaagtatttcaaggagtagctctttaaaaatggtttctaaattagattttaaaaattcattgtcatctaaatgcatgtttagtcacaatgtatcagtattgtgtttaaaggtgctcagcatcactttttgaaaactatgtttacatatttaaaatgtttaattattttgaaatgtatagggtattaaatacaagcttc

SEQ ID NO: 1888 - DNA, 3368 bp, Homo sapiens
gacggtggccgatagtggtcctactgtcgtgggactgctctgcgcgctcccggtggggcgcgcctgcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatgtatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatctgtggaaactgtgcagttgcattttagcctcttcccttccaatttttgtacttttaactacaaaccagtagtatactaatggttatctaatagaaatttaaagtgtcttggtaagtactgagaatttttacttgaattaatcagataagcaacagaaatcaacatatgtagcatggatttgtgctatattggaagtaaaacactataggcagaaagatgtagaaattaagagaattgaaaaagaataatagaattccttggtgtttacagataatttggaaaactttttgatgacagcagagga

SEQ ID NO: 1889 - DNA, 575 bp, Homo sapiens
ggactgctctgcgcgctcccggtggggcgcgcctgcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagacggagtcttgccctgttgcccaggctagagtgccaaggcacgatcttggcttactgcaacctccacttcccagattcaagcagttttcgtgccttagtcacttgaggagctctggttacagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaa

SEQ ID NO: 1890 - DNA, 726 bp, Homo sapiens
gcgcctgcgcattatgctggtctccatggcggggcctcggagccaagacgaggcattcgcttcaagagacaagcagtttagaatcaggcagaactggattgcaaaatttatgggcagaccgagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctca

SEQ ID NO: 1891 - DNA, 537 bp, Homo sapiens
gcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgaggctggagtgcagtgctatgatcacagctgactgcagtcttaacctcccaggatcaagtgatcctcccacctcagccatctgattacctgggactgcagctattaaataatagaagaaaatggaattgaatatgatgtcagcatggaacaatctaatgattcattaagagtcaaccataatgacggtgaagagtcaaaaaccagtg

SEQ ID NO: 1892 - DNA, 595 bp, Homo sapiens
gcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactcttt

SEQ ID NO: 1893 - DNA, 3455 bp, Homo sapiens
cttttcggggtcccacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggcctgtgtattgttctcaatggtcccaagaattactctaatatagttgtttttctgagggaggatggatggagataactatcctgatcccaatgtcactttttaaggcattcgcttcaagagacaagcagtttagaatcaggcagaactggattgcaaaatttatgggcagaccgagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatgtatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatc

SEQ ID NO: 1894 - DNA, 572 bp, Homo sapiens
gcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggctggagtgcagtgctatgatcacagctgactgcagtcttaacctcccaggatcaagtgatcctcccacctcagccatctgattacctgggactgcagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactct

SEQ ID NO: 1895 - DNA, 597 bp, Homo sapiens
attatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagaagttttatcatttgatagtctgtgatccatttcaagttgatttgctatctggtgtgagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgg

SEQ ID NO: 1896 - DNA, 1136 bp, Homo sapiens
atgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttg

SEQ ID NO: 1897 - DNA, 2099 bp, Homo sapiens
attatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcag

SEQ ID NO: 1898 - DNA, 2770 bp, Homo sapiens
attatgctggtctccatggcggggcctcggagccaagacgaggcattcgcttcaagagacaagcagtttagaatcaggcagaactggattgcaaaatttatgggcagaccggtatgtgtgcagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatgtatgtttgtatgtgtgtatgtatatcatgaattttttttttaagttctgaaaaagaacttgttctctccttaaagttgtgaagaaattgttaattgccagacaggtaaga

SEQ ID NO: 1899 - DNA, 868 bp, Homo sapiens
attgagctgcgacccttgttcaacgccgttggcgaagccagctgctggaggtgccgagaatctgagtttcggcaagcagccagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactaaaaa

SEQ ID NO: 1900 - DNA, 928 bp, Homo sapiens
gccgttggcgaagccagctgctggaggtgccgagaatctgagtttcggcaagcagccaggtctggaaactgtaacaggacattcagttagtaatgatggttgcaggttgaatagtctcgccctagatctcacctaacttgcagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactaaaaa

SEQ ID NO: 1901 - DNA, 608 bp, Homo sapiens
gccaggtctggaaactgtgagtgtgtgggcttttctccgacgtcgagcgtggtcctagcgtaaacagatgcattcgcctctccggtttcaatctttttttacgtttgcgctttcctcaaggccggtgggtcaggagtggagccttagtcattctaacgctggaggtgtcagtaggaccaacagagtctggtgccgacacggcttactgttgcgcgctcttctaggcctcaacttcctctcaactgtgtggtaacaggacattcagttagtaatgatggttgcaggttgaatagtctcgccctagatctcacctaacttgcagtaagtatcaagtgcttgtgtgccgattaaagaacaacttcggatacaatgggaggtgtcaaggaaacgaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcag

SEQ ID NO: 1902 - DNA, 477 bp, Homo sapiens
tttttcacatatgaatagacttagtaaaattaacaaaagatgtgaaagatgaggtcaacctttttagaatgggccagttattcacttcaaaatcttgaagccattttcctgaccttatcttctatggtaagagcatataatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcgg

SEQ ID NO: 1903 - DNA, 1025 bp, Homo sapiens
cccttgttcaacgccgttggcgaagccagctgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactaaaaatggatttgaagccaatcattttattttcccttgtatcaaaagaaaagagttccttgtatcaaaagaaaagagttgaactgaaaatttcagtatatacacaattataatagctaggtgattatttcattagtgttcatacattagagtaatggtttatt

SEQ ID NO: 1904 - DNA, 689 bp, Homo sapiens
gaagccagctgctggaggtgccgagaatctgagtttcggcaagcagccaggtctggaaactgtaacaggacattcagttagtaatgatggttgcaggttgaatagtctcgccctagatctcacctaacttgcagtaagtatcaagtgcttgtgtgccgattaaagaacaacttcggatacaatgggaggtgtcaaggaaacgaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatat

SEQ ID NO: 1905 - DNA, 794 bp, Homo sapiens
acgcgctgctgctgtctccgccacctaaggcctaaccaaaggctctcggagaacgtccctacattctttccaacctggcagatggcagctaacggccaaacctctccgggctattcacgtacctggagaaaacgatccccttgcggaggggagcacagaggccaaatcagctcttgccttcacttttcagccacacagcgtgttctcacggccaccggccaaaatggcggtgcccagccgccgcacgcgcaagccataggacgtagtgcgcgcgcgcgacatagagcgtgaggcggaaccctggagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatata

SEQ ID NO: 1906 - DNA, 1164 bp, Homo sapiens
cgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 1907 - DNA, 2685 bp, Homo sapiens
cccgacgccggaagtgcctggagcgcgcgacagcggcggggcggggcggcctggaggctgtggcgcgcggccggcagagggaggggagaggccactggggccgtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagctttatgcttatggaatgtttaaaattgctcgagtcacagggattgctggtacttgtcttgcattatgtttatcaagtgatttgaaatcattatcagtggtcacagaagtctctaccaatggtgcttcagaagtttcatactttcagcttgaaactaatctgttgtactctttcttacctgaagtaactcggatggccagaaagtttactcatatttcagctctgttacagtatataaatttgtcactaacatgtatgtgtgaagcatgggaagaaatactaatgcagatggattctcgtctcaccaagtttgtgcaggaaaagaacacaaccacatcagtgcaagatgagttcatgcacttgctattatgggggaaagcaagtgctgaacttcagactctcttgatgaatcagttaacagtaaagggcttgaaaaagcttggccagtctatagagtcatcatactccagtatacaaaaattggtcataagtcatttacagagtggctcggagtctttattataccatttgagtgaattgaaaggaatggcttcatggaagcaaaaatatgaacctcttggactagatgctgcaggaatcgaagaagctataactgctgtgggttcttttatactcaaggcaaatgaacttcttcaagttatagatagtagtatgaaaaacttcaaagcattttttcggtggctttatgtggcaatgttgagaatgacagaagaccatgtgcttcccgagctgaataagatgactcagaaagatatcacatttgttgctgaatttcttactgaacatttcaatgaggctccagacctttataatcgaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagatgtaattggaaaatcgatgaatcaagcaatctgtattccattgtatagagataccagaagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttca

SEQ ID NO: 1908 - DNA, 595 bp, Homo sapiens
agtctgccggtggggactcttgcaggtacaggcgcggtcggggctcctcgtggagagccgggggctcctgccggcctctgactggggtgtcgttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatg

SEQ ID NO: 1909 - DNA, 2599 bp, Homo sapiens
gaggggagaggccactggggccgtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagctttatgcttatggaatgtttaaaattgctcgagtcacagggattgctggtacttgtcttgcattatgtttatcaagtgatttgaaatcattatcagtggtcacagaagtctctaccaatggtgcttcagaagtttcatactttcagcttgaaactaatctgttgtactctttcttacctgaagtaactcggatggccagaaagtttactcatatttcagctctgttacagtatataaatttgtcactaacatgtatgtgtgaagcatgggaagaaatactaatgcagatggattctcgtctcaccaagtttgtgcaggaaaagaacacaaccacatcagtgcaagatgagttcatgcacttgctattatgggggaaagcaagtgctgaacttcagactctcttgatgaatcagttaacagtaaagggcttgaaaaagcttggccagtctatagagtcatcatactccagtatacaaaaattggtcataagtcatttacagagtggctcggagtctttattataccatttgagtgaattgaaaggaatggcttcatggaagcaaaaatatgaacctcttggactagatgctgcaggaatcgaagaagctataactgctgtgggttcttttatactcaaggcaaatgaacttcttcaagttatagatagtagtatgaaaaacttcaaagcattttttcggtggctttatgtggcaatgttgagaatgacagaagaccatgtgcttcccgagctgaataaggtaatgactcagaaagatatcacatttgttgctgaatttcttactgaacatttcaatgaggctccagacctttataatcgaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagatgtaattggaaaatcgatgaatcaagcaatctgtattccattgtatagagataccagaagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaatttt

SEQ ID NO: 1910 - DNA, 2513 bp, Homo sapiens
gcggatgtctgtttcctgggatattgtgagggcgggcggagatgtagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatta

SEQ ID NO: 1911 - DNA, 1932 bp, Homo sapiens
atggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctag

SEQ ID NO: 1912 - DNA, 2147 bp, Homo sapiens
agggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatta

SEQ ID NO: 1913 - DNA, 660 bp, Homo sapiens
atgctttccccttgtctctcgtcttattttgtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatacctcgcctccctgggaatacagtcccttgttcaacagagagcttttgctgggaagacggcaaacaagctga

SEQ ID NO: 1914 - DNA, 509 bp, Homo sapiens
aagacctgcggacctgggcgtggcggaaggcgcgctgcggcgctgctttctcggttgggtgtttgaaatgggagatagcgtccctgaggaagctgctgcggctttctgggctaggtggtcaagtttccggggaggggagcgcgggaagggccgtggtgaatttgaacacgccggttggctcgaaggcctttgttatgaccgtcagagcagggcctcagatttccttcccagacgttcccgcgttcatgctcggtgatgacctcggggctcctcactcgtgggtccgggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctaca

SEQ ID NO: 1915 - DNA, 1508 bp, Homo sapiens
tttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactaagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatt

SEQ ID NO: 1916 - DNA, 2400 bp, Homo sapiens
caactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatta

SEQ ID NO: 1917 - DNA, 1794 bp, Homo sapiens
gaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccccatggaggatactgagttacccctaaccccgatcctctacccaacatgtcagtttttttttattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaggc

SEQ ID NO: 1918 - DNA, 1695 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaggca

SEQ ID NO: 1919 - DNA, 1346 bp, Homo sapiens
gaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcaggttccgattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaaggcattcgatgcgtgtttaatgatgatgactccgcaagccctctga

SEQ ID NO: 1920 - DNA, 4509 bp, Homo sapiens
ggtcccgcctgccgctggcgccgttgtttccggctcaactggggagctgctggagctcttctggcctctggttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtgagtttcagggcgtcatggccaggggccaccgcggccagccgggtgtgaggctgcctttcgctgcccgcgcgctccagtggtctctgggtccgccggcgtccgtttcggcctgaacgcagcccctccgcggcgacgagcagtctcgcgccggagctcatggcctcggaggcgccgtccccgccgcggtcgccgccgccgcccacctcccccgagcctgagctggcccagctaaggcggaaggtggagaagttggaacgtgaactgcggagctgcaagcggcaggtgcgggagatcgagaagctgctgcatcacacagaacggctgtaccagaacgcagaaagcaacaaccaggagctccgcacgcaggtggaagaactcagtaaaatactccaacgtgggagaaatgaagataataaaaagtctgatgtagaagtacaaacagagaaccatgctccttggtcaatctcagattatttttatcagacgtactacaatgacgttagtcttccaaataaagtgactgaactgtcagatcaacaagatcaagctatcgaaacttctattttgaattctaaagaccatttacaagtagaaaatgatgcttaccctggtaccgatagaacagaaaatgttaaatatagacaagtggaccattttgcctcaaattcacaggagccagcatctgcattagcaacagaagatacctccttagaaggctcatcattagctgaaagtttgagagctgcagcagaagcggctgtatcacagactggatttagttatgatgaaaatactggactgtattttgaccacagcactggtttctattatgattctgaaaatcaactctattatgatccttccactggaatttattactattgtgatgtggaaagtggtcgttatcagtttcattctcgagtagatttgcaaccttatccgacttctagcacaaaacaaagtaaagataaaaaattgaagaagaaaagaaaagatccagattcttctgcaacaaatgaggaaaaggatttgaactcagaggatcaaaaagccttcagtgttgaacatacaagctgcaatgaggaagaaaatttcgcaaatatgaaaaagaaggccaaaataggcattcatcacaaaaatagtccccccaaagtcactgttccaactagtggaaatactatagagtctcctcttcatgaaaacatctctaattcaacatcatttaaagatgagaaaatcatggagactgatagtgaaccagaggaaggtgaaattacagactctcagactgaggatagttatgacgaagccattaccagtgaaggcaatgtaactgcagaagatagtgaggatgaagatgaagacaaaatttggcccccatgtattagagtaattgtcattagatcacctgtgttgcagataggatcactctttatcattactgctgtaaaccctgctacaattggaagagaaaaggatatggaacatactctccgaatccctgaagttggtgtcagtaagtttcatgcagaaatttattttgaccatgacttacaaagttatgtccttgtggatcaaggcagtcaaaatggcacaattgttaatggaaaacagattcttcagccgaaaactaaatgtgacccttacgtacttgagcatggagatgaagtcaaaattggagaaactgtcttatcctttcacattcatcctggcagtgatacctgtgatggctgtgaaccagggcaggttagagcccaccttcgccttgataagaaagatgaatcttttgttggtccaacactaagtaaggaggaaaaagagttggaaagaagaaaagaattaaagaaaatacgagtaaaatatggtttacagaatacagaatacgaagatgaaaagacattgaagaatccaaaatataaagatagagctggaaaacgtagggagcaggttggaagtgaaggaactttccaaagagatgatgctcctgcatctgttcattctgaaattactgatagcaacaaaggtcggaagatgttggagaagatgggttggaagaaaggagagggcctggggaaggatggtggaggaatgaaaacgccgatccagcttcagcttcggcgaacacatgcaggcttggggacaggcaaaccatcctcatttgaagatgttcaccttctccaaaacaagaacaaaaaaaactgggacaaagcacgagagcggtttactgaaaacttcccagaaactaagcctcaaaaagatgacccagggaccatgccttgggtaaaagggactttagagtgaaggctaatcatagaaaaaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttgtcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatatgcatcctcatttattccctttagaacctaggtaaaaaatgttgcgaaaacatgggtagtggcgcatacattttgttatccttgaaatagcctaagtaatgttattgaagaactaatgaacaggtaacatattgtagaaaattagtctttcattgttttcttctgtgaagaatctgttgctatgtactgtatattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatgaaaaagagtgattttttgaaccggtgatttaaatgtattgatctgctttgaattttcaagcagccagaattttctagtttaaattggcagagttataacaaaggagagcctcaaatattagacaattgcagtgcggctttctgggcacaggtgtcactgctctgccacctatcactattctttttctgttcagtttttctctcaggtgtttgctgggaaattaacactggaactgacccttttctggcagtgaatgtaagctctagctcccccatctactataaagaaatgtcttcgagatgtagaaataaggaatattctgaaaataaaaattatacagtagtaaagataattcagaaagaaaaagctacctgttagaatttccagtctaaatggcacagggtagttacggagaaaaggggatggagaaggagaaactatgactaaagatgagaggtatgaacgagttgtcaggttcctatgggcttaagctaggacaatcaggccctaaactccaaatttggataaaatatctctttgcattcttcttggccacctgcatagtctgacacatacgtatgtacagttagacttgcaggctgcaggagtgccctgcattgttttcttttaattagaaataaaaagtattagtctaaatgtggttctggtgctggtgccctgtatatatgtaacaatataggacccctccaaataggttttgcttctggtgaatcttggtcattgggttagtatatgactgtctataatattttccatttgtattattatattggggaaaacattttttatcattttctattaagaaaatggaaaacttaaatatggtgttaaaaatggaaatatatgtgatatttgcattattaaacccctttgcagatctaaagtctcagggttccactattagtggttaaagtactgaataatgtctgggtctatttccatctgtaaaataagaatatttgtctcacgtgtctgtcatgaatagcaaatgagaaaatgtatataaaagcactttgtaaattgtaaaagtagtacagatgtgagcttctatttgtttagaagcataaatgtgaattatatacagtttgaattttgcataaattttttgtgtctaattttaaa

SEQ ID NO: 1921 - DNA, 1142 bp, Homo sapiens
ttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtgagtttcagggcgtcatggccaggggccaccgcggccagccgggtgtgaggctgcctttcgctgcccgcgcgctccagtggtctctgggtccgccggcgtccgtttcggcctgaacgcagcccctccgcggcgacgagcagtctcgcgccggagctcatggcctcggaggcgccgtccccgccgcggtcgccgccgccgcccacctcccccgagcctgagctggcccagctaaggcggaaggtggagaagttggaacgtgaactgcggagctgcaagcggcaggtgcgggagatcgagaagctgctgcatcacacagaacggctgtaccagaacgcagaaagcaacaaccaggagctccgcacgcaggtggaagaactcagtaaaatactccaacgtgggagaaatgaagataataaaaagtctgatgtagaagtacaaacagagaaccatgctccttggtcaatctcagattatttttatcagacgtactacaatgacgttagtcttccaaataaagtgactgaactgtcagatcaacaagatcaagctatcgaaacttctattttgaattctaaagaccatttacaagtagaaaatgatgcttaccctggtaccgatagaacagaaaatgttaaatatagacaagtggaccattttgcctcaaattcacaggtaataaaatgctaaacatgaaactgttgatgcccaagaacctgtccttctttgttgttattatgtggaaagatagacttctttggtccgtcacagcatatataagggttataaacattcttatgtgtaattatgcaaagaatgttgtagtttttccaaaaccagaattagaacttcttcatatatgtagtggttttcctactacattgtgttccaaaattttgtgatctacataaactaaaacaaaatttgtccagatattttgactgaacaaaagaactgtggacaacaataccacatttacacctaaaaaaa

SEQ ID NO: 1922 - DNA, 6888 bp, Homo sapiens
ccaggagctgccttggcagtcacgccccttccttccgaggagctttctggctgcctaaactggtagaccccctgaattactcctccatctccgctctctttcgcctcctcttctcttagttctctccgcctccccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcccatccctggccgctggcccgggaccgaagccacttgagcgagcagagagtcgtcaccttgtcttctttgccttcagggagctgctaagaaggacaaataagatagcagagtgaaagagcttttgtctccttagaaggaaggctgagaaactaaaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatccactttgtgcctatcttttcactgacaataaagttagctattttaaaatgcagtaccgtgtggaaaatgctttggtgtttacccgacagaggctttatttgtgctgtatcagtgattactttcaattcagtatgcagtgaaattgcctttcaagggcagcgtgcagcagaatttgcatttgcttgaagtatggaatgtgattatagattataaagtattaagacaacaccacaggccgcatgctctaatcggtctctttatatactcaggcagcatatattaaaagctttgcatctttttatcttctggtttctagggataaaatgatggccacccaaagcagagaatttatcctttggttagcattttggaaggccccttgatattccttttgtacccttgttctgatgccaattcatcagtttt

SEQ ID NO: 1923 - DNA, 2462 bp, Homo sapiens
gtcactggccaccagtggagttaaggcccatccacctgttaccagtgctcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggtaatgacagtaaataaggaagattatagtcacgtgttcaaagagagccctgagataagcacccatgcttaaggaaaagggatgatggtccaggttctagagaggaaggtgtaccagggttttggagtttttttttcctcctgagaccctagttccacattctggagctcctccacactttgaagtctcccggtgagaataccgattgaggccaaggcttagaggacaagaatcttgagtttcatttgggtgtcaaggaagataactctaatttcctctaaactattctcagatttggcctttgccatgtggcacctttatctttctccaaagcccatgtggcctttgtgtcgttccaaatgtcaaaattccggcatttctgtgttccttcctcctctataataggagaacccagagttttagttacactaaatcgtttgggtagcaggttttgttcccacagtgttgtgagatgagaacagaatgtactttttcattccgttcctgtccattccctcccctctaatcaaa

SEQ ID NO: 1924 - DNA, 6945 bp, Homo sapiens
atgagaaattctgaagaacagccaagtggagggaccacggtattgcagcgtttgctacaagagcagcttcgctatggcaatcctagtgagaatcgcagcctgcttgccatacaccagcaagccacagggaatggccctcctttccccagtggcagtgggaacccgggccctcagagtgatgtgttgagtccccaagaccaccaccaacagcttgtggctcatgctgctcgacaagaaccccaggggcaggaaatccagtcagaaaacctcatcatggagaagcagctgtctcctcgaatgcaaaataatgaagaactcccgacctatgaagaagccaaggtccagtcccagtactttcggggccaacagcatgccagtgttggagctgccttctatgtcactggagtcaccaaccagaagatgaggactgagggacgcccatcagttcagcggctcaatcctggaaagatgcaccaagatgagggactcagagaccttaagcaagggcatgtccgttccttgagtgaacgactaatgcagatgtcactggccaccagtggagttaaggcccatccacctgttaccagtgctcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatccactttgtgcctatcttttcactgacaataaagttagctattttaaaatgca

SEQ ID NO: 1925 - DNA, 2720 bp, Homo sapiens
tcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttccc

SEQ ID NO: 1926 - DNA, 1816 bp, Homo sapiens
cttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggctgctgctgctgccccgtctccagccactgccgctgctactgctgctgctgtttctccagctgctgctggtcagattccagctgctgcctctgttgcctcagct

SEQ ID NO: 1927 - DNA, 3330 bp, Homo sapiens
taagcaagaattccctatcctgatcaaggctttaagcctaaaagaaagcagaaataggcaccaccagcaatagagatgagaaattctgaagaacagccaagtggagggaccacggtattgcagcgtttgctacaagagcagcttcgctatggcaatcctagtgagaatcgcagcctgcttgccatacaccagcaagccacagggaatggccctcctttccccagtggcagtgggaacccgggccctcagagtgatgtgttgagtccccaagaccaccaccaacagcttgtggctcatgctgctcgacaagaaccccaggggcaggaaatccagtcagaaaacctcatcatggagaagcagctgtctcctcgaatgcaaaataatgaagaactcccgacctatgaagaagccaaggtccagtcccagtactttcggggccaacagcatgccagtgttggagctgccttctatgtcactggagtcaccaaccagaagatgaggactgagggacgcccatcagttcagcggctcaatcctggaaagatgcaccaagatgagggactcagagaccttaagcaagggcatgtccgttccttgagtgaacgactaatgcagatgtcactggccaccagtggagttaaggcccatccacctgttaccagtgctcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaa

SEQ ID NO: 1928 - DNA, 1922 bp, Homo sapiens
tgcagctgcaggcaagcctggccactgttggctgcagcaggacatcccaggcacagcccctagggctctgagcagacatccctcgccattgacacatcttcagatgctctcccagctagccatgctgcagggcagcctcctccttgtggttgccaccatgtctgtggctcaacagacaaggcaggaggcggataggggctgcgagacacttgtagtccagcacggccactgtagctacaccttcttgctgcccaagtctgagccctgccctccggggcctgaggtctccagggactccaacaccctccagagagaatcactggccaacccactgcacctggggaagttgcccacccagcaggtgaaacagctggagcaggcactgcagaacaacacgcagtggctgaagaagctagagagggccatcaagacgatcttgaggtcgaagctggagcaggtccagcagcaaatggcccagaatcagacggcccccatgctagagctgggcaccagcctcctgaaccagaccactgcccagatccgcaagctgaccgacatggaggctcagctcctgaaccagacatcaagaatggatgcccagatgccagagacctttctgtccaccaacaagctggagaaccagctgctgctacagaggcagaagctccagcagcttcagggccaaaacagcgcgctcgagaagcggttgcaggccctggagaccaagcagcaggaggagctggccagcatcctcagcaagaaggcgaagctgctgaacacgctgagccgccagagcgccgccctcaccaacatcgagcgcggcctgcgcggtgtcaggcacaactccagcctcctgcaggaccagcagcacagcctgcgccagctgctggtgttgttgcggcacctggtgcaagaaagggctaacgcctcggccccggccttcataatggcaggtgagcaggtgttccaggactgtgcagagatccagcgctctggggccagtgccagtggtgtctacaccatccaggtgtccaatgcaacgaagcccaggaaggtgttctgtgacctgcagagcagtggaggcaggtggaccctcatccagcgccgtgagaatggcaccgtgaattttcagcggaactggaaggattacaaacagggcttcggagacccagctggggagcactggctgggcaatgaagtggtgcaccagctcaccagaagggcagcctactctctgcgtgtggagctgcaagactgggaaggccacgaggcctatgcccagtacgaacatttccacctgggcagtgagaaccagctatacaggctttctgtggtcgggtacagcggctcagcagggcgccagagcagcctggtcctgcagaacaccagctttagcacccttgactcagacaacgaccactgtctctgcaagtgtgcccaagtgatgtctggagggtggtggtttgacgcctgtggcctgtcaaacctcaacggcgtctactaccacgctcccgacaacaagtacaagatggacggcatccgctggcactacttcaagggccccagctactcactgcgtgcctctcgcatgatgatacggcctttggacatctaacgagcagctgtgccagaggctggaccacacaggagaagctcggacttggcactcctggacaacctggacccagatgcaagacactgtgccaccgccttccctgacaccctgggcttcctgagccagccctccttgacccagaagtccagaagggtcatctgccccccaactcccctccgtctgtgacatggagggtgttcggggcccatccctctgatgtagtcctcgcccctcttctctccctcccccttcaggggctccctgcctgagggtcacagtaccttgaatgggctgagaacagaccaaa

SEQ ID NO: 1929 - DNA, 1702 bp, Homo sapiens
agacagaggtttgtagctgcagctgcaggcaagcctggccactgttggctgcagcaggacatcccaggcacagcccctagggctctgagcagacatccctcgccattgacacatcttcagatgctctcccagctagccatgctgcagggcagcctcctccttgtggttgccaccatgtctgtggctcaacagacaaggcaggaggcggataggggctgcgagacacttgtagtccagcacggccactgtagctacaccttcttgctgcccaagtctgagccctgccctccggggcctgaggtctccagggactccaacaccctccagagagaatcactggccaacccactgcacctggggaagttgcccacccagcaggtgaaacagctggagcaggcactgcagaacaacacgcagtggctgaagaagctagagagggccatcaagacgatcttgaggtcgaagctggagcaggtccagcagcaaatggcccagaatcagacggcccccatgctagagctgggcaccagcctcctgaaccagaccactgcccagatccgcaagctgaccgacatggaggctcagctcctgaaccagacatcaagaatggatgcccagatgccagagacctttctgtccaccaacaagctggagaaccagctgctgctacagaggcagaagctccagcagcttcagggccaaaacagcgcgctcgagaagcggttgcaggccctggagaccaagcagcaggaggagctggccagcatcctcagcaagaaggcgaagctgctgaacacgctgagccgccagagcgccgccctcaccaacatcgagcgcggcctgcgcggtgtcaggcacaactccagcctcctgcaggaccagcagcacagcctgcgccagctgctggtgttgttgcggcacctggtgcaagaaagggctaacgcctcggccccggccttcataatggcaggtgagcaggtgttccaggactgtgcagagatccagcgctctggggccagtgccagtggtgtctacaccatccaggtgtccaatgcaacgaagcccaggaaggtgttctgtgacctgcagagcagtggaggcaggtggaccctcatccagcgccgtgagaatggcaccgtgaattttcagcggaactggaaggattacaaacagggcttcggagacccagctggggagcactggctgggcaatgaagtggtgcaccagctcaccagaagggcagcctactctctgcgtgtggagctgcaagactgggaaggccacgaggcctatgcccagtacgaacatttccacctgggcagtgagaaccagctatacagggtggtggtttgacgcctgtggcctgtcaaacctcaacggcgtctactaccacgctcccgacaacaagtacaagatggacggcatccgctggcactacttcaagggccccagctactcactgcgtgcctctcgcatgatgatacggcctttggacatctaacgagcagctgtgccagaggctggaccacacaggagaagctcggacttggcactcctggacaacctggacccagatgcaagacactgtgccaccgccttccctgacaccctgggcttcctgagccagccctccttgacccagaagtccagaagggtcatctgccccccaactcccctccgtctgtgacatggagggtgttcg

SEQ ID NO: 1930 - DNA, 2805 bp, Homo sapiens
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataa

SEQ ID NO: 1931 - DNA, 2368 bp, Homo sapiens
gatgagaggaactagaagcagctattgcaagctaccattttgagaacctgcccaaagaaagaaaagactgaagggatggaagattgcagaaagcatgatcggagaagagatattttacttttagtgaagctctatacacatttgtcttcctcactagatttgtatccctagaacctagaacagagtcagccaaagagcaggcactcaatacaaattgttgacttgctgctaaaattgtaacagagtacaaagaacatcctagaaattggagacaaaggggataagaaaacagagttaacttggaaagagaagacactcatctctgacaagactgaagatgattacacaacaccatcattgccaaccaagtcctttgggaatacaaaggttaaatcctaatcatcacaacagtctctaaaggaataaacctgatttacagattttgataacaaaatacttctcctctttccattttctacaatgcaaccaacagcaacatcaaagaggtttttaactgaagactctatgctctgtagttctttccacaaagagctgactgatatttgaagaagtgttttcatctatccaagaaaaatatgatgtctccatcccaagcctcactcttattcttaaatgtatgtatttttatttgtggagaagctgtacaaggtaactgtgtacatcattctacggactcttcagtagttaacattgtagaagatggatctaatgcaaaagatgaaagtaaaagtaatgatactgtttgtaaggaagactgtgaggaatcatgtgatgttaaaactaaaattacacgagaagaaaaacatttcatgtgtagaaatttgcaaaattctattgtttcctacacaagaagtaccaaaaaactactaaggaatatgatggatgagcaacaagcttccttggattatttatctaatcaggttaacgagctcatgaatagagttctccttttgactacagaagtttttagaaaacagctggatccttttcctcacagacctgttcagtcacatggtttagattgcactgatattaaggataccattggctctgtcaccaaaacaccgagtggtttatacataattcacccagaaggatctagctacccatttgaggtaatgtgtgacatggattacagaggaggtggacggactgtgatacagaaaagaattgatgggataattgatttccagaggttgtggtgtgattatctggatggatttggagatcttctaggagaattttggctaggactgaaaaagattttttatatagtaaatcagaaaaataccagttttatgctgtatgtggctttggaatctgaagatgacactcttgcttatgcatcatatgataatttttggctagaggatgaaacgagattttttaaaatgcacttaggacggtattcaggaaatgctggtgatgcattccggggtctcaaaaaagaagataatcaaaatgcaatgccttttagcacatcagatgttgataatgatgggtgtcgccctgcatgcctggtcaatggtcagtctgtgaagagctgcagtcacctccataacaagaccggctggtggtttaacgagtgtggtctagcaaatctaaatggcattcatcacttctctggaaaattgcttgcaactggaattcaatggggcacgtggaccaaaaacaactcacctgtcaagattaaatctgtttcaatgaaaattagaagaatgtacaatccatattttaaataatctcatttaacattgtaatgcaagttctacaatgataatatattaaagatttttaaaagtttatcttttcacttagtgtttcaaacatattaggcaaaatttaactgtagatggcatttagatgttatgagtttaattagaaaacttcaattttgtagtattctataaaagaaaacatggcttattgtatgtttttacttctgactatattaacaatatacaatgaaatttgtttcaagtgaactacaacttgtcttcctaaaatttatagtgattttaaaggattttgccttttctttgaagcatttttaaaccataatatgttgtaaggaaaattgaagggaatattttacttatttttatactttatatgattatataatctacagataatttctactgaagacagttacaataaataactttatgcagattaatatataagctacacatgatgtaaaaaccttactatttctaggtgatgccataccattttaaaagtagtaagagtttgctgcccaaatagtttttcttgttttcatatctaatcatggttaactattttgttattgtttgtaataaatatatgtacttttatatcctga

SEQ ID NO: 1932 - DNA, 1857 bp, Homo sapiens
gcatcccagctccactcccaggctctgggggctggggagtggttaccaagcctcctctctccttctgtcccactgccctctccccgtctctagctcagaggccccactggaccctcggctcttccttggacttcttgtgtgttctgtgagcttcgctggattcagggtcttgggcatcagaggtccgccgcgatggggaagccctggctgcgtgcgctacagctgctgctcctgctgggcgcgtcgtgggcgcgggcgggcgccccgcgctgcacctacaccttcgtgctgcccccgcagaagttcacgggcgctgtgtgctggagcggccccgcatccacgcgggcgacgcccgaggccgccaacgccagcgagctggcggcgctgcgcatgcgcgtcggccgccacgaggagctgttacgcgagctgcagaggctggcggcggccgacggcgccgtggccggcgaggtgcgcgcgctgcgcaaggagagccgcggcctgagcgcgcgcctgggccagttgcgcgcgcagctgcagcacgaggcggggcccggggcgggcccgggggcggatctgggggcggagcctgccgcggcgctggcgctgctcggggagcgcgtgctcaacgcgtccgccgaggctcagcgcgcagccgcccggttccaccagctggacgtcaagttccgcgagctggcgcagctcgtcacccagcagagcagtctcatcgcccgcctggagcgcctgtgcccgggaggcgcgggcgggcagcagcaggtcctgccgccacccccactggtgcctgtggttccggtccgtcttgtgggtagcaccagtgacaccagtaggatgctggacccagccccagagccccagagagaccagacccagagacagcaggagcccatggcttctcccatgcctgcaggtcaccctgcggtccccaccaagcctgtgggcccgtggcaggattgtgcagaggcccgccaggcaggccatgaacagagtggagtgtatgaactgcgagtgggccgtcacgtagtgtcagtatggtgtgagcagcaactggagggtggaggctggactgtgatccagcggaggcaagatggttcagtcaacttcttcactacctggcagcactataaggcgggctttgggcggccagacggagaatactggctgggccttgaacccgtgtatcagctgaccagccgtggggaccatgagctgctggttctcctggaggactgggggggccgtggagcacgtgcccactatgatggcttctccctggaacccgagagcgaccactaccgcctgcggcttggccagtaccatggtgatgctggagactctctttcctggcacaatgacaagcccttcagcaccgtggatagggaccgagactcctattctggtaactgtgccctgtaccagcggggaggctggtggtaccatgcctgtgcccactccaacctcaacggtgtgtggcaccacggcggccactaccgaagccgctaccaggatggtgtctactgggctgagtttcgtggtggggcatattctctcaggaaggccgccatgctcattcggcccctgaagctgtgactctgtgttcctctgtcccctaggccctagaggacattggtcagcaggagcccaagttgttctggccacaccttctttgtggctcagtgccaatgtgtcccacagaacttcccactgtggatctgtgaccctgggcgctgaaaatgggacccaggaatcccccccgtcaatatcttggcctcagatggctccccaaggtcattcatatctcggtttgagctcatatcttataataacacaaagtagccacag

SEQ ID NO: 1933 - DNA, 2503 bp, Homo sapiens
cgctcttattggccaggggacggtagctgcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccc

SEQ ID NO: 1934 - DNA, 4022 bp, Homo sapiens
gagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgagg

SEQ ID NO: 1935 - DNA, 3141 bp, Homo sapiens
gctcttattggccaggggacggtagctgcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttaagggacatttttatgacttttatgtgtatgtttatgtagaaatttggaaaatacagaaaactgtaaagaaaataaaagccctttatatcaacgtcaagagataa

SEQ ID NO: 1936 - DNA, 1881 bp, Homo sapiens
aggactctgctctcctgcggccatgggccagggttgggctactgcaggacttcccagcctcctcttcctgctgctctgctacgggcaccctctgctggtccccagccaggaggcatcccaacagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatgggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagc

SEQ ID NO: 1937 - DNA, 3460 bp, Homo sapiens
gccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccaccccttctcccagcacacggctgcctga

SEQ ID NO: 1938 - DNA, 1478 bp, Homo sapiens
agaaggggcagagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaccaagtatcaggggatctgtcctcctgttacccgaaacgaaacccactttgatgctggagctaagtttcatgttccaaatgtgacaccatacatcaggta

SEQ ID NO: 1939 - DNA, 2356 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaa

SEQ ID NO: 1940 - DNA, 2172 bp, Homo sapiens
agggcatgccattgcaagagaatgctcagccatgttcatctggggacctgctcctggtagagcaataggatctgtgtgcccagcaccactgcccacctagctgtcctggcctgtgcccaatgctgaccttcacctcagagtgtggctgtaccacattcggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgc

SEQ ID NO: 1941 - DNA, 2252 bp, Homo sapiens
agccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgagtccgcgcggaccgccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaatgtat

SEQ ID NO: 1942 - DNA, 2328 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcggatgaagaaaatgaatcacaagtcaactgacagtccaaaggctccacagctcagaggaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgc

SEQ ID NO: 1943 - DNA, 1545 bp, Homo sapiens
cttgctacttcatcatcctcatcgtgaacattattattattatcatcattttccagatgaagaaaatgaatcacaagtcaactgacagtccaaaggctccacagctcagaggaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactg

SEQ ID NO: 1944 - DNA, 1795 bp, Homo sapiens
gttttgcaccaaactggacacatgcttgctacttcatcatcctcatcgtgaacattattattattatcatcattttccagatgaagaaaatgaatcacaagtcaactgacagtccaaaggctccacagctcagaggaggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgacactgaactaaagaaccagaaaatagaggggtgtattagtgaactacagaaaattcaagtcccaaaagctgtaaatactctgaggaccaaagaaaatatatacgttgttcagatttgccctgaggggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactg

SEQ ID NO: 1945 - DNA, 1669 bp, Homo sapiens
gttttgcaccaaactggacacatgcttgctacttcatcatcctcatcgtgaacattattattattatcatcattttccagatgaagaaaatgaatcacaagtcaactgacagtccaaaggctccacagctcagaggaggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactg

SEQ ID NO: 1946 - DNA, 2359 bp, Homo sapiens
cgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaa

SEQ ID NO: 1947 - DNA, 2412 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccagatgaagaaaatgaatcacaagtcaactgacagtccaaaggctccacagctcagaggaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgc

SEQ ID NO: 1948 - DNA, 2882 bp, Homo sapiens
agaaggaaaccagagatctggtgctattacgtcccagcgtctgagagaacgagtaagcacagaattcaaagcattctgcagcctgaattttgaaggagtgtgtttaggcactaagcaagctgatttatgataactgctttaaacttcaacaaccaaaggcataagaactaggagctgctgacatttcaatatgaagggcaactccacccttgccactactagcaaaaacattaccagcggtcttcacttcgggcttgtgaacatctctggcaacaatgagtctaccttgaactgttcacagaaaccatcagataagcatttagatgcaattcctattctttactacattatatttgtaattggatttctggtcaatattgtcgtggttacactgttttgttgtcaaaagggtcctaaaaaggtttctagcatatacatcttcaacctcgctgtggctgatttactccttttggctactcttcctctatgggcaacctattattcttatagatatgactggctctttggacctgtgatgtgcaaagtttttggttcttttcttaccctgaacatgtttgcaagcattttttttatcacctgcatgagtgttgataggtaccaatctgtcatctacccctttctgtctcaaagaagaaatccctggcaagcatcttatatagttccccttgtttggtgtatggcctgtttgtcctcattgccaacattttattttcgagacgtcagaaccattgaatacttaggagtgaatgcttgcattatggctttcccacctgagaaatatgcccaatggtcagctgggattgccttaatgaaaaatatccttggttttattatccctttaatattcatagcaacatgctattttggaattagaaaacacttactgaagacgaatagctatgggaagaacaggataacccgtgaccaagtcctgaagatggcagctgctgttgttctggccttcatcatttgctggcttcccttccatgttctgaccttcctggatgctctggcctggatgggtgtcattaatagctgcgaagttatagcagtcattgacctggcacttccttttgccatcctcttgggattcaccaacagctgcgttaatccgtttctgtattgttttgttggaaaccggttccaacagaagctccgcagtgtgtttagggttccaattacttggctccaagggaaaagagagagtatgtcttgccggaaaagcagttctcttagagaaatggagacctttgtgtcttaaacgtgagagcaaaatgcatgtaatcaacatggctacttgctttgaggctcaccagaattatttttaagtggttttaataaaataataaaatttcccctaatcttttctgaatcttctgaaaccaaatgtaactatgttttatcgtccagtgactttcaggaattgcccattgtttttctgatatgtttgtacaagattgtcattagtgagacatatttacaacctagaagtaactggtgatatatctcaaattgtaattaataatagattgtgaataatgatttggggattcagatttctctttgaaacatgcttgtgtttcttagtggggttttatatccatttttatcaggatttcctcttgaaccagaaccagtctttcaactcattgcatcatttacaagacaacattgtaagagagatgagcacttctaagttgagtatattataatagattagtactggattattcaggctttaggcatatgcttctttaaaaaagctataaattatattcctcttgcatttcacttgagtggaggtttatagttaatctataactacatattgaatagggctaggaatatagattaaatcatactcctatgctttagcttatttttacagttatagaaagcaagatgtactataacatagaattgcaatctataatatttgtgtgttcactaaactctgaataagcactttttaaaaaactttctactcattttaatgattgtttaaaggtttctattttctctgatacttttttgaaatcagtaaacactgtgtattgttgtaaaatgtaaaggtcacttttcacatccttgactttttagatgtgctgctttgatatataggacattgatttgatttttattattaatgctttggttctgggttgtttcctaaaatatctgggtggcttaaaaaaaactctttaacttgtaataaacccttaactggcataggaaatggtatccagaatggaattttgctacatggggtctgggtgggggcaaagagacccagtcaattacatgtttggtaccaagaaaggaacctgtcagggcagtacaatgtgactttgaaaatatataccgtgggggtagttttaccctatatctataaacactgtttgttccagaatctgtatgattctatggagctattttaaaccaattgcaggtctagatacctccttctcagcactattaaagctcctaagttagaggagtgcctaaaactgagttacctaaagtttacttacattaaagtatgaatattaattttagaaatttgagactttattctgtaccagccctgtataataacaggttatctaggaccttcctctgaggtaggtctaaatactgatctctgaggcggaactaacgttttggggactcagcatctctgccaggttccaggattatagacagaagagtcctgtcataccactttctggaaaagtcctaatttcatgtaatccttttattttcaataaaaacaaatagctaaatgtataaccaactatgatgttatgttttcaataattttgtaaaacagctcatataaataaaatttttaattggaagaa

SEQ ID NO: 1949 - DNA, 2291 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccgggggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgatgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactatctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaaccatagctggttatttctcccttgtgttagtaataaacgtcttgccacaataagcctccaaaaa

SEQ ID NO: 1950 - DNA, 1691 bp, Homo sapiens
aagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctggatgttgctgctgagaagattgacaggttcatgcaggctgtgacaggatggaagactggctgctccctgatgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactatctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgta

SEQ ID NO: 1951 - DNA, 8203 bp, Homo sapiens
agagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaaaaaaaaaatattttaaagatataaatatatgctgtatatgttatgtaatttattttaggctataatacatttcctattttcgcattttcaataaaatgtctctaatacaatacggtgattgcttgtgtgctcaacatacctgcagttgaaacgtattgtatcaatgaacattgtaccttattggcagcagttttataaagtccgtcatttgcatttgaatgtaaggctcagtaaatgacagaactatttttcattatgggtaactggggaataaatgggtcactggagtaggaatagaagtgcaagctggaaaggcaaaaatgagaaagaaaaaggcaggccctttgtgtctaccgttttcagtgctgtgtgatcatattgttcctcacagcaaaaaagaatgcaagggcataatgttagctgtgaacatgccagggttgcattcacattcctgggtacccagtgctgatggggtgtgcccacgtggggacatgtccttggcgtgcttcctcagagtggcttttcctccattaatacatatatgagtactgaaaaattaagttgcatagctgctttgcagtggtttcagaggcagatctgagaagattaaaaaaaaatctcaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcacttaaggtcaggagtttgagaccagcctggccaacatggcaaaaccctgtctctactaaaaacataaaaattagctgggggtggtagcacatacctgtaatcccagctactcaggaggctgaggcaggagaatttgcttgatcctgggaggcagaggttgtagtgagccgagatcgcgccatcgcactccagcctgggtgacaagagcaaaactccatctcaaaaaaaaaaaaaatcctttccctctaaatccaggaaggatcagcaagggcctcctcattatgagatgaggaaatacaactccagagattccttcagtgatcaagatcagtgggccataatatttggttagagtttctgagaacacaggaagcaatgccacactcaggccaccacaatggagctgatttggcaggacttgttcaaacctttcaccttaaagcacgtgatccttcttcgtacattttcttcacttgggctgcttaagtcacagcctaacaactttgaggcaaaactgagaactggcatattctcctgcgtttcttctaatcgagtcccatcatccagctagacatgagagatcaaaccagggagggtgacctttctccttcccacttttcagagtcattggggcaactttttgacttttgtgaccaaagaaacattcccccaaaacatttatttttcattgtagggcattcagctgacagctgcattttagaaagttaccatgcctgtgagattctcatgtcaaagaccagggaaagaccaggtgtgactttctccaaaactgagtgattgcttgtggatgaatacaatctaaaaatacaaggccatgaagtagtttttcatttagatgctgagaaataataggtttgggcagctcaaagcataggaaatagtaagggttttctagagctcctcctttggtggcctgtttgagtagcacaagggacgtcatcctaaatgtgcagttgccatttgttctgtagtgacttacagggatctcagtggcaaagggcgtcagtgagacaacaactgagcaaaaagaactagacgaggcttgcgcttggaaagtcacggtaggattggacctgccggccacatggctcagggagtattgacggatttgcacattggcaggaaactctcccgtttgggattctttaaatggggcacagaaggccacttgtttgcatttctgggtaaaaaacagtcatcccccatgactgcctgcatcgggtttgtcttgtgccaaagttactcttcctttgtttttactttgccttgatttttagcattagctggtagtttggcttggaaatgtcctggatagccgattccctaagaaactgaaacatttaatattggcttaggatgtatcagatggggccaaataaagcttctttacaatagtaaaagcactttatacttcactctctgagtcttcccaataaataaccttgggaggtgcagggggtggggggcccaggatggggaggcctgggagctcccagggtagtgacagagttgggctgagttctccagacgccaggatgcgtcgcagcggggccagctcaggagtgctcactcccagccctctggatctctctcctggttggaataatcattacatatcgtaactctcaaaatttattcacttatattttcagaataagaagtgtgaaatgttaacagctctctgctctcttacttgttccccatttggggatcttctggagggaaggggcagggggagagtaacttttctatatccttggtttctaggaacacatcgatttgaagactcagtagctgactggtttttttttttcccccttcaaactgaagtgcgagtgtgcgtgtgttccacaaaatagcaagtatttatagtgttgtaattacatttccttgagaaatattttcttgtatttaaaaatctttctacttcagtaactcccagcagaacagtgcccaggacagcatgtgccggttagtaccagctttgcaggtgagctgacttctaaacttaggacgacgtcttcatcaatcaaactagtgcacagtccagaaaaaggggtcctttatcttctaagttctgctcctcacctttctttggaaccaaaattgcagtggagtgtgaggaagagctttgaaagacgtggagtgttgagatgtctgcattgcacattcagccggttcaaagccagcagctcctgcctgcattctgtagacatcgccctcacacacagtcctctgatggctctcatataaagcactcaaaccgtaggaaagcatgtttttgagcaacgtgtctgggatactcctctgtgtggttattttgaatctctatttctgtcattgaagcagcaaaaaacatcatgtgactcatcaactgatctaatcacacttaaaacaggatgtagagaaaaatctgatgagaaacgtaaaagggcctgttgcctgcccttttaaaggcaaaatgtctaaaatcatgcaaatgttcaaaatgagagaaattgcattgtggaatcaaaataacccaaactccactcagaaaagtcacaaatatatagtatactatctgatctcaaaagggaaaaacgagatgataagaccttaagtttagactttattttcttctcaagagtggacattaaatctattaacttgcaactttctgctgggaagagcatcaaaggtgggcctcctaaatcatttttgaaaaacctctgtcaagtccaagtggttccaggagaattatagccagtatcttttaaaatatttcattttagtgataatgtttttctctgcttcatttgcaatcaaccaggatctctaaaagactgcataagatatatgcacttttataggtggctgtcagctacacatagattcagcaaattttttttatatagtacctgtttttaagttaggctacataacttaaagtgcactttactaacaagacttgacattagcgtctacaatatgtatatgtaaacaaaagcacacaagaactaggcaccctttctctctccaagagtttaagtggtttccttaggttaaagaaggggacagaccagctaaaaatggttgtaccactcactgtacaacctcatggaaattctcactataagatttagaggcaatgttccctagctataagccagggcaagaaatggcgcctctggagttggggaacattaggggaacattacaaccgggtagatgctggttccctgaagtgtggggccatgaacatgcagggacccacggtttgaatgaaacagctactgaaagctaagttcaaaccacccttgcgtaacaaaggagtacagggtacacatcaacaccaatcacccagcaccccacagcgatggtcatgtcaccgtgcagcaggtcccttaccccagggctgccacatccacaagccttgcagtggcaaatacgctgctccttggatttaatgagatattttggttgcttaatgatgtactgatcagggaactgtctaaagctagtagggccaaggagttaatcaaagggcttcgggaaagtggacaagagccacacacgtgattctgttccatgccgacactcattcatttaagaagtgtattcaagctggaggcttccatatcactcacgcttcttggcctcaccttgctcatctgtccaatgggaggcttgagccattattgctaaggccccttcctgatctaacattctgtttatgatctaggatttagaacgtcgtatgagatcctacaatggaagaataaaatcacctcattcttcatttcagatctgaacattagcagtgatctagatttttttttttttaaacaaaattaagtgtgcttagagtcattcctctacatgggctgtggctgtcagcccataggtttgtcagtttcacatcaaaactgtgggtataaactgttgaaaccaatcacattaaaatatttagctgggcacagtggtgtgcatctgtagtcccagctacttgggaggctgaggcaggaggatcgcttaagcacaggagttggaatccagcctgagcaacagagcaaaaccccgtctctaaaatacaaataaaatatttgtgtagtttttgattaaaattgactacagcggtcagtataaaatacatgtcgcttttaaggaagtgctctttatgtatctaacagatggaagtttttgcattggtaagagcatttatatatgctttgtttcagggtttatggatttgtattcatatattgtcaaataggtttcatactctaattttactttaagtaaagcttaaacacttggcatacaa

SEQ ID NO: 1952 - DNA, 1722 bp, Homo sapiens
gtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgccccttcctgatctaacattctgtttatgatctaggatttagaacgtcgtatgagatcctacaatggaagaataaaatcacctcattcttcatttcagatctgaacattagcagtgatctagatttttttttttttaaacaaaattaagtgtgcttagagtcattcctctacatgggctgtggctgtcagcccataggtttgtcagtttcacatcaaaactgtgggtataaactgttgaaaccaatcacattaaaatatttagctgggcacagtggtgtgcatctgtagtcccagctacttgggaggctgaggcaggaggatcgcttaagcacaggagttggaatccagcctgagcaacagagcaaaaccccgtctctaaaatacaaataaaatatttgtgtagtttttgattaaaattgactacagcggtcagtataaaatacatgtcgcttttaaggaagtgctctttatgtatctaacagatggaagtttttgcattggtaagagcatttatatatgctttgtttcagggtttatggatttgtattcatatattgtcaaataggtttcatactctaattttactttaagtaaagcttaaacacttggcatacaactg

SEQ ID NO: 1953 - DNA, 1160 bp, Homo sapiens
gtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaa

SEQ ID NO: 1954 - DNA, 6379 bp, Homo sapiens
gggaggcggcgggccctgcccagagcccgtcccgggcgccggcaagcgagctccggccgcggcggcagcgccatcccgggccgcgggcagccgcccctcgccctccgcgtccggaactgccttcgccttcccgcgaccccgcagcagccggccctcggggcgccacgaacgctgtcccctctgtggagcagagacccccttccccttcttagggggtgtcgcctcggggatcgctgagcgctaggggtccaggaggcggggacgggagcgccgtgacccgccatggctcaagcggccaaacagctgaagaaaatcaaagacatcgaggcgcaggccctccaggagcagaaggagaaggaggaatccaacaggaagcggagaaaccgctcccgtgaccgaaagaagaaggccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggaactgctcatataactataatgggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctgg

SEQ ID NO: 1955 - DNA, 8297 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcacaggg

SEQ ID NO: 1956 - DNA, 1185 bp, Homo sapiens
actcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctgg

SEQ ID NO: 1957 - DNA, 8237 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcacaggg

SEQ ID NO: 1958 - DNA, 579 bp, Homo sapiens
actcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaaggatcacacctcgacacccaacccct

SEQ ID NO: 1959 - DNA, 8225 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggc

SEQ ID NO: 1960 - DNA, 4641 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggcatcagcaccaataacccc

SEQ ID NO: 1961 - DNA, 8090 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggc

SEQ ID NO: 1962 - DNA, 8366 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggc

SEQ ID NO: 1963 - DNA, 8006 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggc

SEQ ID NO: 1964 - DNA, 3094 bp, Homo sapiens
gtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggc

SEQ ID NO: 1965 - DNA, 11775 bp, Homo sapiens
atgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggttcaagaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctgctcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaacaggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatgacgtgagtgaggaagtagaggaaatacctgcttcggatgctcaacttaactcccaaatggggatttcagcctccactgaaacacctacaaaagaagctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaa

SEQ ID NO: 1966 - DNA, 5589 bp, Homo sapiens
atgagtcaccacatccagcggtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggccgcgcctctccatgtcttgaacgtgacaacagcagtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagattggtcaagaatccagacgatatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggattctatggaa

SEQ ID NO: 1967 - DNA, 14196 bp, Homo sapiens
gtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggttcaagaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctgctcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaacaggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatgacgtgagtgaggaagtagaggaaatacctgcttcggatgctcaacttaactcccaaatggggatttcagcctccactgaaacacctacaaaagaagctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtggcaa

SEQ ID NO: 1968 - DNA, 6313 bp, Homo sapiens
gtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctcta

SEQ ID NO: 1969 - DNA, 5848 bp, Homo sapiens
ctcctcctcctgctttcctccagtaagtgcatacccgctagtggtctgtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaagacagaaaccaccacagaaattcatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaaggagctaacagaggaattaggggagctggaggccagctcagatgaggaggcgatggtaactaccagggttgtccgccggcgagtgattattcagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggtcactttgtgtgagcccagcattttgtccagtacctcacaatttcaggctgagccagtggaaggccgtagagtcagcaaagttgttaaaacaactgtggtacttggagagaggatggagaaacatctgggggattctagtttagccactgatcttccttcagccaaagatgactttgaagag

SEQ ID NO: 1970 - DNA, 3537 bp, Homo sapiens
acagtctgaggctgtaatgggaaagtcggttcctgggctgctgtctcatagacatcagcttgcagggaagctgggggctctccgaattgccctgctccggggcccctcctgctgcgtgactcacaggcacattgcagagagaagctgccgctcccagtaagtaatgaaaagagacatgaagaattggtatttcaaatgaccaccatgttgcaaaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaa

SEQ ID NO: 1971 - DNA, 5270 bp, Homo sapiens
agtaagtgcatacccgctagtggtctgtacaggcggcacggtttgatggcagagatattttctttccaaactgttcaaaatgatgaacgaagatgcagctcagaaaagcgacagtggagagaagttcaacggcagtagtcagaggagaaaaagacccaagaaggtgacatgcccccagatgaaaccagaggccgccaacattgaaaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaag

SEQ ID NO: 1972 - DNA, 8051 bp, Homo sapiens
acagtctgaggctgtaatgggaaagtcggttcctgggctgctgtctcatagacatcagcttgcagggaagctgggggctctccgaattgccctgctccggggcccctcctgctgcgtgactcacaggcacattgcagagagaagctgccgctcccagtaagtaatgaaaagagacatgaagaattggtatttcaaatgaccaccatgttgcaaaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggccgcgcctctccatgtcttgaacgtgacaacagcagtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgt

SEQ ID NO: 1973 - DNA, 7202 bp, Homo sapiens
acagcaggaggaggataggccgcgctgggcgggcgtcgcggggccgcgcttggtgttcctgagccgcggccgaactttttcccaagaagtcccacgtttggaggcccgaggagcgggacggggaggagagactggagttcctggaaggagcagcagcagcagccccacaacatggcctcctccgcctcctcctctcccgcgggcaccgaggactccgctcctgcccagggtggctttggatcagattattcacgaagctctagaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcaccta

SEQ ID NO: 1974 - DNA, 5792 bp, Homo sapiens
aagcagcggctgctttgcctggggagcacccgtaaatggactttggtctcaatgctttgactctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtaatagatgcacatggtacaaaattcccaaggtacaagagtttacggtgaaaagtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgaga

SEQ ID NO: 1975 - DNA, 14771 bp, Homo sapiens
ggacaccatcatttgggtttttaaaagcttcagcttctccagcatctttgcattgtgaatatcttcctgcttctagtcaaagctttctctctagtgattggaatgctgctgtaagcctgattagaggtgcctgaggatatcaccttttacaaggaagccgtgtgtgcttgagaggatctttttaaatgcattatggctcatgcagcctcacaattaaagaaaaacagggatttagaaatcaatgctgaagaagagcctgagaaaaaaaggaaacaccgcaaacggtcccgggatcggaagaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaaggagacagagtcagatcaagatgatgagattgagaaaacagatagacgacagagcttcgcatccttagctttacgtaagcgctacagctacttgactgagcctggaatgattgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatcctttcggacaatgtcttcgccgataaaaactgtggtgtcacaatctccatacaatatccaagtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcagcagttgatgtcatttcatcagccaaaattacaatggcatcttctctctcatcacctgtgaagcagatgcctggacatgcagaggtagcattagtcaatggatctatttcccctctaaaatatccatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgaggagagacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaagcactggtcctaaaccactttttcatgaagttcccatccctcctgtcattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgacgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacacagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcaccta

SEQ ID NO: 1976 - DNA, 3811 bp, Homo sapiens
agctgagaacaaagttgaaagtttgcctggagctccatgccactccccgcctgggccactgctttgttttcttctaatgtttttcctctacctgggttggctgtttcttcattcatatttgagaagaatcacctcctaattaaatgtagcacttcgctctctccctacatgaaggctgtcttggttacccgactaggcaacgcgcattggtatcaaattaccgaaagtctacaccggagcagtcctcatatttacatacaaataactcaggggcttgcatttatgtcaccattctgtcctgctagaggcttgccagaggagtttttaatccaatcagaaggagctttaaaaggatgtctgcgaagtggtcaaaaggatcttaacctcaattaagtggggttttttaaaaagatttttttgggggcctgaaattttgaaaatcttcgaactctgagtggggaaagatgtataattcctcaattgcctacgaggatatcaagatgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaa

SEQ ID NO: 1977 - DNA, 3306 bp, Homo sapiens
atgagtgaagaaccaaaggagaaaaatgcaaaacctgctcataggaaaaggaaaggaaaaaagtctgatgccaatgcaagttacttaagagcagctcgagctggacaccttgaaaaggccctcgactacatctcagtagtggacaccctgaagatagtgaccgaagagaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagggagaaggttttaaggtgaaaacgaagaaagaaatccggcatgtggaaaagaagagccactcgtaa

SEQ ID NO: 1978 - DNA, 4593 bp, Homo sapiens
ggacaccatcatttgggtttttaaaagcttcagcttctccagcatctttgcattgtgaatatcttcctgcttctagtcaaagctttctctctagtgattggaatgctgctgtaagcctgattagaggtgcctgaggatatcaccttttacaaggaagccgtgtgtgcttgagaggatctttttaaatgcattatggctcatgcagcctcacaattaaagaaaaacagggatttagaaatcaatgctgaagaagagcctgagaaaaaaaggaaacaccgcaaacggtcccgggatcggaagaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaaggtgaagatgcaatgaccggggacacagacaaatatcttgggccacaggaccttaaggaattgggtgatgattccctgcctgcagagggttacatgggctttagtctcggagcgcgttctgccagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtgagtttcctaacacatttactaatacgtggattttcataagaagagacattttttctatacaaaccaaattt

SEQ ID NO: 1979 - DNA, 5593 bp, Homo sapiens
tctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtaatagatgcacatggtacaaaattcccaaggtacaagagtttacggtgaaaagtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgaga

SEQ ID NO: 1980 - DNA, 4563 bp, Homo sapiens
ggacaccatcatttgggtttttaaaagcttcagcttctccagcatctttgcattgtgaatatcttcctgcttctagtcaaagctttctctctagtgattggaatgctgctgtaagcctgattagaggtgcctgaggatatcaccttttacaaggaagccgtgtgtgcttgagaggatctttttaaatgcattatggctcatgcagcctcacaattaaagaaaaacagggatttagaaatcaatgctgaagaagagcctgagaaaaaaaggaaacaccgcaaacggtcccgggatcggaagaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgatagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtgagtttcctaacacatttactaatctacgtggattttcataa

SEQ ID NO: 1981 - DNA, 3459 bp, Homo sapiens
agctttaaaaggatgtctgcgaagtggtcaaaaggatcttaacctcaattaagtggggttttttaaaaagatttttttgggggcctgaaattttgaaaatcttcgaactctgagtggggaaagatgtataattcctcaattgcctacgaggatatcaagatgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtgatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgc

SEQ ID NO: 1982 - DNA, 2796 bp, Homo sapiens
tttactttggctcatgttccccagagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaaggtgaagatgcaatgaccggggacacagacaaatatcttgggccacaggaccttaaggaattgggtgatgattccctgcctgcagagggttacatgggctttagtctcggagcgcgttctgccagccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctggctattcttctccacttcctcagtatgattcaaggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggtaccttgttcacaaaaacaagttcatttcattacgtactccagatatgaggttttattttgtggtcttaatagcactcactataaaataccaagtgcattattgattttacttttactttaa

SEQ ID NO: 1983 - DNA, 1644 bp, Homo sapiens
agcctccccgaaagtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccagaatatagttcaattaagttgtctccta

SEQ ID NO: 1984 - DNA, 1965 bp, Homo sapiens
cggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtg

SEQ ID NO: 1985 - DNA, 1306 bp, Homo sapiens
ggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcaggtactctaccttctggccaatggagcccgctgcgaggccaacaccttcgatggtgagcgctgcctctatggggcactgagtgaccccatccgccgggctctacgcgattacaagcacccactgctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgagcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctag

SEQ ID NO: 1986 - DNA, 1975 bp, Homo sapiens
ggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatg

SEQ ID NO: 1987 - DNA, 1961 bp, Homo sapiens
gtttacatccgccgggtgcgcggcttcgccgcccgaggtcgttcggctcgggtaccatcctccgcgccatggacaccagcgacctgttcgccagctgcaggaagggggatgtgggccgagtgcgaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtggga

SEQ ID NO: 1988 - DNA, 2065 bp, Homo sapiens
aaaggtccagcctcggcactggctctggcttctgtccctgtagcccatcgtcccccagcactgatagcacacagtgtctgcctgttcgaccccacctccacatccttgcctgcactttgccttgagtgcctctcctgctctggtctgcctgtcacctgccctcacctgggggaggcttccccataccaaaagggatgttttctctccgttcctttccacgggccttctttctcagaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcac

SEQ ID NO: 1989 - DNA, 7569 bp, Homo sapiens
agtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggaacctgacagaacttcacaggagaactctcctgcccttttaggagtgcaaaaagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaatg

SEQ ID NO: 1990 - DNA, 8370 bp, Homo sapiens
agtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaatg

SEQ ID NO: 1991 - DNA, 8319 bp, Homo sapiens
agtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaatg

SEQ ID NO: 1992 - DNA, 8374 bp, Homo sapiens
agtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaatg

SEQ ID NO: 1993 - DNA, 8221 bp, Homo sapiens
gggaggcagcaggttaggcagtgagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaa

SEQ ID NO: 1994 - DNA, 2035 bp, Homo sapiens
ggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggta

SEQ ID NO: 1995 - DNA, 2135 bp, Homo sapiens
ctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggta

SEQ ID NO: 1996 - DNA, 8376 bp, Homo sapiens
agtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaatg

SEQ ID NO: 1997 - DNA, 2387 bp, Homo sapiens
atgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttacactttgggaagctgaggcgagtggtttacatgaggtcaggagtttgagacaagcctggccaacatggtgaaactccatctctactaaaaatataaaaaatagccaggcatgat

SEQ ID NO: 1998 - DNA, 3234 bp, Homo sapiens
aaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtc

SEQ ID NO: 1999 - DNA, 2543 bp, Homo sapiens
cggacccgaggagcaggaagcggcggctccttcggccacccaggcagcagccacagcggggagtgcgcggcgcggggacaggaagagaggggcaatggctgccgaccccaccgagctgcggctgggcagcctccccgtcttcacccgcgacgacttcgagggcgactggcgcctagtggccagcggcggcttcagccaggtgttccaggcgcggcacaggcgctggcggacggagtacgccatcaagtgcgccccctgccttccacccgacgccgccagctctgatgtgaattacctcattgaagaagctgccaaaatgaagaagatcaagtttcagcacatcgtgtctatctacggggtgtgcaagcagcccctgggtattgtgatggagtttatggccaacggctccctggagaaggtgctgtccacccacagcctctgctggaagctcaggttccgcatcatccatgagaccagcttggccatgaacttcctgcacagcattaagccgcctctgctccacctggacctcaagccgggcaacatactcctggacagcaacatgcatgtcaaaatttcagacttcggcctgtccaagtggatggaacagtccacccggatgcagtacatcgagaggtcggctctgcggggcatgctcagctacatcccccctgagatgttcctggagagtaacaaggccccaggacctaaatatgatgtgtacagctttgcaattgtcatctgggagctactcactcagaagaaaccatactcagggttcaacatgatgatgattattatccgagtggcggcaggcatgcggccctccctacagcctgtctctgaccaatggccaagcgaggcccagcagatggtggacctgatgaaacgctgctgggaccaggaccccaagaagaggccatgctttctagacattaccatcgagacagacatactgctgtcactgctgcagagtcgtgtggcagtcccagagagcaaggccctggccaggaaggtgtcctgcaagctgtcgctgcgccagcccggggaggttaatgaggacatcagccaggaactgatggacagtgactcaggaaactacctgaagcgggcccttcagctctccgaccgtaagaatttggtcccgagagatgaggaactgtgtatctatgagaacaaggtcacccccctccacttcctggtggcccagggcagtgtggagcaggtgaggttgctgctggcccacgaggtagacgtggactgccagacggcctctggatacacgcccctcctgatcgccgcccaggaccagcaacccgacctctgtgccctgcttttggcacatggtgctgatgccaaccgagtggatgaggatggctgggccccactgcactttgcagcccagaatggggatgacggcactgcgcgcctgctcctggaccacggggcctgtgtggatgcccaggaacgtgaagggtggacccctcttcacctggctgcacagaataactttgagaatgtggcacggcttctggtctcccgtcaggctgaccccaacctgcatgaggctgagggcaagacccccctccatgtggccgcctactttggccatgttagcctggtcaagctgctgaccagccagggggctgagttggatgctcagcagagaaacctgagaacaccactgcacctggcagtagagcggggcaaagtgagggccatccaacacctgctgaagagtggagcggtccctgatgcccttgaccagagcggctacggcccactgcacactgcagctgccaggggcaaatacctgatctgcaagatgctgctcaggtacggagccagccttgagctgcccacccaccagggctggacacccctgcatctagcagcctacaagggccacctggagatcatccatctgctggcagagagccacgcaaacatgggtgctcttggagctgtgaactggactcccctgcacctagctgcacgccacggggaggaggcggtggtgtcagcactgctgcagtgtggggctgaccccaatgctgcagagcagtcaggctggacacccctccacctggcggtccagaggagcaccttcctgagtgtcatcaacctcctagaacatcacgcaaatgtccacgcccgcaacaaggtgggctggacacccgcccacctggccgccctcaagggcaacacagccatcctcaaagtgctggtcgaggcaggcgcccagctggacgtccaggatggagtgagctgcacacccctgcaactggccctccgcagccgaaagcagggcatcatgtccttcctagagggcaaggagccgtcagtggccactctgggtggttctaagccaggagccgagatggaaatttagacaacttggccagccgtggtggctcacgtctgtaatcccagcactttgggaggctgaggcaggcagatcacctgatatcaagagtttgaggccagcctggccaacatggcaaaaccctgtctctgctaaaaatacaaaatttagctgggta

SEQ ID NO: 2000 - DNA, 6994 bp, Homo sapiens
tcggttagccgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatacggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgaggctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaatgcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggttttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcaggagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 2001 - DNA, 2168 bp, Homo sapiens
agacaactcagaagacactagacaacagcagtcttatctaaagaaataagacctccaaggacgaagcatcagaatgcttcaattaactggggaaaatgagaagaattgtgaagtttcagaacgtatcagaaggtccggaccatggaaagagatttcttttggggattatatttgtcacacatttcagggagattgctgggctgatcgatccccacttcatgaagctgcagctcaggggcgcttactggcccttaaaactttaattgcacaaggtgtcaatgtgaaccttgtgacaattaaccgggtgtcttctctccacgaggcatgccttggaggtcacgtggcctgtgccaaagccttattggaaaatggtgcacacgtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtcacagagagtgcatggagatcctgctggcaaataatgttaacattgaccatgaggtgcctcagctcggaactcccctatatgtggcctgcacctaccagagggtagactgtgtgaagaaacttctagaattaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctggtataattttgattttttgtatatatatacgtatatatatatacatacatatacgtatatatatatacgtatatatatacacacacacacatgcactcatatatttaatgttttcaaagtccttaatatatatagttcatatatgttttcaaagtccttaatatatgtataaagcttatatatatatgttttcaaagttctttatatataaagttatatatatttatatagactttatatatatatacatatataaagttaaggacttcagaaacattgtagttaactgaggcttccagttactgcggtcctggttgataagagagactttggaagagatcagtgcacccagaggttggcatctattgcttattgcttctgatattaaatgctgttatttgaagtaagcagttctaggattgagaacactgggtgtccccaacaacctgaacccacaggcattgtctgaggcatgttgcaacccaagcactggcttattttcaaagtcaagatgctcagggtttttgaaataattacatactgatgccagccaccaaagtgggctcaatgctgggtcaatatttttttctgtggataggggcccaaaataagcacaaaggtatataaaaagaggcttctccttttctgtcttctccttcttctcatttctctctccttctgtcacccctcctcttcctctattctttctcttttttgtgaatttaga

SEQ ID NO: 2002 - DNA, 1484 bp, Homo sapiens
aactcagtgaaattttacagtcctaggaccctatacagagcataagccaaaatggaagatggtcctgttttctatggctttaaaaacatttttattacaatgtttgctacgttttttttctttaagcttttaattaaagtttttttggctctcctaacccatttctatatcgtcaaaggaaatagaaaagaagcggctaggatagcagaagagatctatggtggaatttcagattgctgggctgatcgatccccacttcatgaagctgcagctcaggggcgcttactggcccttaaaactttaattgcacaaggtgtcaatgtgaaccttgtgacaattaaccgggtgtcttctctccacgaggcatgccttggaggtcacgtggcctgtgccaaagccttattggaaaatggtgcacacgtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtcacagagagtgcatggagatcctgctggcaaataatgttaacattgaccatgaggtgcctcagctcggaactcccctatatgtggcctgcacctaccagagggtagactgtgtgaagaaacttctagaattaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctggt

SEQ ID NO: 2003 - DNA, 2866 bp, Homo sapiens
agacaactcagaagacactagacaacagcagtcttatctaaagaaataagacctccaaggacgaagcatcagaatgcttcaattaactggggaaaatgagaagaattgtgaagtttcagaacgtatcagaaggtccggaccatggaaagagatttcttttggggattatatttgtcacacatttcagggagattgctgggctgatcgatccccacttcatgaagctgcagctcaggggcgcttactggcccttaaaactttaattgcacaaggtgtcaatgtgaaccttgtgacaattaaccgggtgtcttctctccacgaggcatgccttggaggtcacgtggcctgtgccaaagccttattggaaaatggtgcacacgtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtcacagagagtgcatggagatcctgctggcaaataatgttaacattgaccatgaggtgcctcagctcggaactcccctatatgtggcctgcacctaccagagggtagactgtgtgaagaaacttctagaattaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctggtataattttgattttttgtatatatatacgtatatatatatacatacatatacgtatatatatatacgtatatatatacacacacacacatgcactcatatatttaatgttttcaaagtccttaatatatatagttcatatatgttttcaaagtccttaatatatgtataaagcttatatatatatgttttcaaagttctttatatataaagttatatatatttatatagactttatatatatatacatatataaagttaaggacttcagaaacattgtagttaactgaggcttccagttactgcggtcctggttgataagagagactttggaagagatcagtgcacccagaggttggcatctattgcttattgcttctgatattaaatgctgttatttgaagtaagcagttctaggattgagaacactgggtgtccccaacaacctgaacccacaggcattgtctgaggcatgttgcaacccaagcactggcttattttcaaagtcaagatgctcagggtttttgaaataattacatactgatgccagccaccaaagtgggctcaatgctgggtcaatatttttttctgtggataggggcccaaaataagcacaaaggtatataaaaagaggcttctccttttctgtcttctccttcttctcatttctctctccttctgtcacccctcctcttcctctattctttctcttttttgtgaatttagatcctttgcccattttaaaatcagattatttgttttgttgttgtcaagtatgattcagcaatcccattactggatatttatcagaaagaaaggaaatcaatgtatggaagaggtagttgcacctccatgtttattgtagctctattcagaaaagcaagatatgaaatcaacttaaatgtctgtcaacagatcaatggataaagaaaatgtggtatatatacaaaatgaaatactattcagccttaaaaaagaaggaaattctgtcatttgcagcaacatggatgagcctagaggacattatgttaagtaagtcacgcacagaaagataaacaccatatgttcttgcttacatgtggaagctaaaaaaattgagctcacagaaacagagagtagaattatgcttattagaggctgggaagggtagtgaggaggggacaatagggcaatgttggttaatggatacaaaattataattggatagaagaaataatttctagtgtttcatagcactgtagggtaaatgtggttaacaataatttattatgtattttcgaaaacctagaagagaagattttgaatgttcatagcagaaatgataaatgattgaggtgatggatatgctaatcaccctgatttgattacttctaggtattaaaatatcactctgtaccccataaatatatacagttattacatacc

SEQ ID NO: 2004 - DNA, 2748 bp, Homo sapiens
atacagagcataagccaaaatggaagatggtcctgttttctatggctttaaaaacatttttattacaatgtttgctacgttttttttctttaagcttttaattaaagtttttttggctctcctaacccatttctatatcgtcaaaggaaatagaaaagaagcggctaggatagcagaagagatctatggtggaatttcagattgctgggctgatcgatccccacttcatgaagctgcagctcaggggcgcttactggcccttaaaactttaattgcacaagcatgccttggaggtcacgtggcctgtgccaaagccttattggaaaatggtgcacacgtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtcacagagagtgcatggagatcctgctggcaaataatgttaacattgaccatgaggtgcctcagctcggaactcccctatatgtggcctgcacctaccagagggtagactgtgtgaagaaacttctagaattaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctggtataattttgattttttgtatatatatacgtatatatatatacatacatatacgtatatatatatacgtatatatatacacacacacacatgcactcatatatttaatgttttcaaagtccttaatatatatagttcatatatgttttcaaagtccttaatatatgtataaagcttatatatatatgttttcaaagttctttatatataaagttatatatatttatatagactttatatatatatacatatataaagttaaggacttcagaaacattgtagttaactgaggcttccagttactgcggtcctggttgataagagagactttggaagagatcagtgcacccagaggttggcatctattgcttattgcttctgatattaaatgctgttatttgaagtaagcagttctaggattgagaacactgggtgtccccaacaacctgaacccacaggcattgtctgaggcatgttgcaacccaagcactggcttattttcaaagtcaagatgctcagggtttttgaaataattacatactgatgccagccaccaaagtgggctcaatgctgggtcaatatttttttctgtggataggggcccaaaataagcacaaaggtatataaaaagaggcttctccttttctgtcttctccttcttctcatttctctctccttctgtcacccctcctcttcctctattctttctcttttttgtgaatttagaacatgggaactggatagacttttaattattgtaagtattactgtcatggttcagtattcagttctaaaatgaaaattccctctcagatcatcctaagactcatttcacacatgtttttttttcccccaatttttctagacctttggctctcaactggagacaattttgccccactcccactgagacatttgtcaatgtctgcagacatgtttagttgcaacaactgggggagaattgctactatcatctagacggtggagatcagggatgcagctaatcaccctacagtgcacaggagccagcaacaaagaattatcagatctggccgggcatggtggctcacgcctgtaatcccagcattttgggaggccgaggcaggcagatcgcactgtcaggagttcgagaaccgcctggccactatggtgaaaccctgtctctactaaaaatacaaaagttagccaggcgtggtggcaggtgcctatagtcccagctacttgggaggctgaggcaggagaatcacttgaacccgggaggcggagattgcagtaagccaagatcacgccactgcactccagcctgggtgacagagcgagactccgtctcaaaacaaaaaaaaaaaaaa

SEQ ID NO: 2005 - DNA, 2743 bp, Homo sapiens
aggttactatagtgtctgctcctacccctgggacaagatcccctaatgagctggcaggtgggcgtggggggcacaggtacagcttggcttctcagctttgctcccctatcctctgctttgccatgaatctctcatccagccccgcagggatctgcctggccagcagtgagcctgagcccctttcatcctgggacctgccgaccacggctcacatcctcctgggtgaagaatgtcaccttgcttcctatctgcctctttcgtggttggctggggagggggaccggggggtggggtgaggttaacctcattgttgtcttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagccatgacccgcttctcctatgcagagtacttttccctctttcactcctgctctgcaccctccaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgcgagcgcaagaacgcggaggccgtgaagattctggtgcagcacaatgcagacaccaaccaccgctgcaaccgcggctggaccgctctgcacgagtctgtgtctcgcaatgacctggaggtcatgcagatcctggtgagcggaggagccaaggtggaatccaagaacgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcccccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcagaacctccaagacctctggctcacctttgccgactgcgggttcgaaaggccattgggaaataccgtataaaactcctagacaccttgccgctcccaggcaggctgattagatacctgaaatacgagaacacccagtaactggggccacggggagagaggagtagcccctcagactcttcttactaagtctcaggacgtcggtgttcccaactccaaggggacctggtgacagacgaggctgcaggctgcctccctctcagcctggacagctaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtga

SEQ ID NO: 2006 - DNA, 2729 bp, Homo sapiens
attcgatgcacccggaggaacggaaggcaggattgcagcttcctcagtgcaacctccaaacaggaaatctgagatgtataacatcttatagtttggcttgtcaacgttggtcatgcggtggccccaaaataaactccctgcttcaaaggacagcgtttcagaactgcctggcagagcagccagaagcttggggccagggcagaaggaaaactcggggagcatgttctgaattaagacactttcaagaaaatcctttgtattacccctgaattgtacccttgtttcagagcctaacagggttttctgatttgctgttccctcctccccactgggtgtctgttctggaggccagggtgagaggtggaggaggagtacagcctgtacagcagcctgagcgaggatgaactggtgcagatggccatcgagcagagcctagcggacaagacaaggggcccaaccactgctgaggccaccgcgtctgcatgtaccaaccgccaacctgcccatttctacccatggaccaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgcgagcgcaagaacgcggaggccgtgaagattctggtgcagcacaatgcagacaccaaccaccgctgcaaccgcggctggaccgctctgcacgagtctgtgtctcgcaatgacctggaggtcatgcagatcctggtgagcggaggagccaaggtggaatccaagaacgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcccccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcagaacctccaagacctctggctcacctttgccgactgcgggttcgaaaggccattgggaaataccgtataaaactcctagacaccttgccgctcccaggcaggctgattagatacctgaaatacgagaacacccagtaactggggccacggggagagaggagtagcccctcagactcttcttactaagtctcaggacgtcggtgttcccaactccaaggggacctggtgacagacgaggctgcaggctgcctccctctcagcctggacagctaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtgacacctgcccagtg

SEQ ID NO: 2007 - DNA, 1959 bp, Homo sapiens
agctggggtccctttggagacactccaggaaaaggggggcacatacccccactgggcttttcctgatgctgacaggggctgctctggctgttcctaagtggaactcgtcaaggtggcagtgacggtgctgatggggacctcaggacttatctgatcagtttcccatcgtccttgctgggtctgttgcttcaccggcatctgtgctctgacaccattaataaccacagagtctgagagtcaggaggaagtgctgctcacgctggaggaagtggctgggagagtgcaggggctggtggcagagaccgcccagagcccatcctagcccaacatggcgtgggtgtcctgggaatgaggcctgcctccagcctcaccttctccatctgggaaatgggactattgatgcagaagcctccccaaaagtggatctgagaggcatagacatcgtggttctcacggactctccaaggatgaggcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgcgagcgcaagaacgcggaggccgtgaagattctggtgcagcacaatgcagacaccaaccaccgctgcaaccgcggctggaccgctctgcacgagtctgtgtctcgcaatgacctggaggtcatgcagatcctggtgagcggaggagccaaggtggaatccaagaacgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcccccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggtcttggagggctttgttaagtattaatataataaatgttacacatgtg

SEQ ID NO: 2008 - DNA, 2842 bp, Homo sapiens
acaaatgatgacatcacgtgagggccaaagctccgggatcctctctgaagtgagagtctgtattcgatgcacccggaggaacggaaggcaggattgcagcttcctcagtgcaacctccaaacaggaaatctgagatgtataacatcttatagtttggcttgtcaacgttggtcatgcggtggccccaaaataaactccctgcttcaaaggacagcgtttcagaactgcctggcagagcagccagaagcttggggccagggcagaaggaaaactcggggagcatgttctgaattaagacactttcaagaaaatcctttgtattacccctgaattgtacccttgtttcagagcctaacagggttttctgatttgctgttccctcctccccactgggtgtctgttctggaggccagggtgagaggtggaggaggatggccacgcagatcagcactcggggcagccagtgtaccattgggcaggaggagtacagcctgtacagcagcctgagcgaggatgaactggtgcagatggccatcgagcagagcctagcggacaagacaaggggcccaaccactgctgaggccaccgcgtctgcatgtaccaaccgccaacctgcccatttctacccatggaccaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgcgagcgcaagaacgcggaggccgtgaagattctggtgcagcacaatgcagacaccaaccaccgctgcaaccgcggctggaccgctctgcacgagtctgtgtctcgcaatgacctggaggtcatgcagatcctggtgagcggaggagccaaggtggaatccaagaacgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcccccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcagaacctccaagacctctggctcacctttgccgactgcgggttcgaaaggccattgggaaataccgtataaaactcctagacaccttgccgctcccaggcaggctgattagatacctgaaatacgagaacacccagtaactggggccacggggagagaggagtagcccctcagactcttcttactaagtctcaggacgtcggtgttcccaactccaaggggacctggtgacagacgaggctgcaggctgcctccctctcagcctggacagctaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtgacacctgcccagtg

SEQ ID NO: 2009 - DNA, 2043 bp, Homo sapiens
gtctctcgttttcggacggctgcagcatcgcggtggggatcgaaagcgggggcttctgggacgcagctctggagacgcggcctcggaccagccatttcggtgtagaagtggcagcacggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacat

SEQ ID NO: 2010 - DNA, 1960 bp, Homo sapiens
aggcccgggtgtccggcggagggggcggtgccctcggcgtctccgtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagt

SEQ ID NO: 2011 - DNA, 1734 bp, Homo sapiens
agacgacatatcaacatccgggggtcgcggagccgtccgcctacgggggccgggacgtcgcctgcgcgtctctcgttttcggacggctgcagcatcgcggtggggatcgaaagcgggggcttctgggacgcagctctggagacgcggcctcggaccagccatttcggtgtagaagtggcagcacggcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagt

SEQ ID NO: 2012 - DNA, 2113 bp, Homo sapiens
aaaactgcgagcctgaaaaacctggctcaagcgcccctcgtgaggcgggcagcgggagtggccgggctctgggccccaggaggcaggcgacggaggcgcggagggtgcggggcgcaggcgggacgccaggcccgggtgtccggcggagggggcggtgccctcggcgtctccgtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaa

SEQ ID NO: 2013 - DNA, 2205 bp, Homo sapiens
gcgtctctcgttttcggacggctgcagcatcgcggtggggatcgaaagcgggggcttctgggacgcagctctggagacgcggcctcggaccagccatttcggtgtagaagtggcagcacggcaggtcggtgagtctcggaggcggcagccgcttcctgaagccattcccgctgctctccagtgggcaggcagaggtttgacccacacggagtgatagcgggaagaagacagtgtgaaccgtgcgggtgcgggtccttagatgagaaaattcgaagtagcgatgagatgtgagaaatggcggtgttcctgactgacctgccttcttgcagcttttcttctttttctccgcatttggcatttgtacacttcatttttcccgcttgaggcttatctccatctcttctgctgtggaccgtggccatctcgttacttaacagcttctgactaacgcagggcagtttgttcagcgactgcaactctgtgttaggggaaacctggggtgaggtagcccgccatctccccgtaggtgaataccgcaagcctccgaatttggcgtggtgggcgactctcgtggaatgggcagctagacatcacaaccctacatttttaccctccatctctagattgaagtgttggggtgttgttttatcaaggaagctgattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagt

SEQ ID NO: 2014 - DNA, 1626 bp, Homo sapiens
gttttcggacggctgcagcatcgcggtggggatcgaaagcgggggcttctgggacgcagctctggagacgcggcctcggaccagccatttcggtgtagaagtggcagcacggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttaggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggagtggagctgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagt

SEQ ID NO: 2015 - DNA, 3825 bp, Homo sapiens
cagcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgatacaggcctgccattcttgtcctaaagcaattgaagttgtagtcaatgcctatgaacacatcagatggaacacaaagtggagaagagctatccccgatgatgacttggagaaatactgggatttttaccactctctctttactgtgtgctgtaactctccaaggactctcatgcacttatcgagatgtgccattagaagaacattacacaacagatgccatagagcaattcctttgctttccctcccattgtcattgaaaaagtacttgcttttagagccagagggaattatttattaagccttatgagacagcagttcccaatcctaggtatttaagtggacttgctgggtagacacagtttgcctaaataaaatggtacttgggttgattataacacttcagggatttcaaaacactttacaaacactgccattaatcctagaatatcatggtatggggaaataaagaagaagtaaagttaaggaattttcaaagacaaggatgtattcagaatgtactgatagaacagtaataactaatatgtatagtgttcttactaagtacctgaaatatttttgtaaaacttcttatatcttatctcatctgaaatgggacccaggttttcttccaaccaatataattctgtgccttatcagtaatatgtttacattctcattcaaatggccatatagcaggctttgcaattggcctcttaaacttggtgttttcccccattaccccttagcagtaattactgtcactagttttgcaaactcctactccccaaaccaagctactcaagtttatttcagtgatgaaggcatatgagcatagtcaaaacaaggagatcttggagtcaaattagaaatgagaaagaaacatcagtccagttaatagtcaagaatggacatttgaaccagacatcactgagccagagactggagatgcaaagatgagtcccatgtgactcctgccttccaggatctcaccatttagcagaggatccagacatacacacagctaactgcaatataaagtgatggggcaagagtacaggtgcagactcacttttaatgcttatctttcaaagttgtgtttctgacatgaagtgtgatttttcttttaagcatgaagttaaagagtgaaggggttatgtaaagtagagggatctcctgctcttgttagggtatttttaaggttttttctagatagtgtgtctttttggtatggtttcttggttagtattaatactttcccagactccttgagaaaaatattgcacactcaatggctccagtgcatgtgacaaggaagcataggaaaatgggggaaagaaagtgtgtgaggggacctagttgattacttcggtctttttatgtagcagactgacatttcatagcattgtagctaagagataaggagcactttgctagtgacagtgggctacgaaaagtaaatagagagactttttgaaaatggtaaaagtttgagaaacttgggaagattagtgtgttaatcaggcttgctagttagtggattgcagaaagaaaaatgtaggtgattaagctctgggccttgtggtttatgaggtcaattttgcttcacttttttttttgttcttgctataatcacttttagataagctcattgctcttagcatcattttttagaggttaaagcagaagtaaattgcaaacaaatctgtcagttgtgagcagatttcttttatgtgtgtggttctccatcatatttaactttggatgctggagtgttgaatagagatgatgtcagatattccaataggctatcatttaatgttaactggcaatcacctaactggttaatctcagttgagactgtgcttctgaactgggattgtcttactcccagggctgtgtaagaaaagtcataggtggatacaataatctcttttaagtatcagttttactcagatattttggtggagatattttgtactaaaacaagatctatatcatggaatagaatgctgaatttgtatgaattattcacataaagcttgatctttcaaaaaatagtttgcttgcagcaagtggtattagaacacatcctaaaacagaatgaaatgatgtcttttgcagcaacttggatggagctggaggccattattctaagtgaagtaactcaggaatggaaagtgaaataccatatgttctcacttataagtgggagctaagcaatgaggatgcaaagacatccagagtgatataatggactatggggacttgcaaggggaagcttgagagtggggtgagggataaaagactacatattgggtacagtgtacactgctccagtgatgggtgcactaaaatctcaaaattcaccactaaagaatgtatccatgtaaccaaaaaccacctgtacccccaaaactattgaaatcttaaaatagtaataattaacaaagtaaaacaagatcacaccctggaacaattggaggattgcttgctgccctgcatcttaaggcgtattctagcagcaaagcttgtgatgcactgacttggggcaagtaaaactgatgctgaggacaaagggagaagatgttcctcgcccagggaaatgaaaacttttcttattcaccttgcttgtgcttaaacacttatgttcatctagtgtagaatacatggctacttgtttgtaatttttttattggtggaattaaagtaatttttccttatctttgaacttttatttagagaacttaaataaagctcttctgtctcctttc

SEQ ID NO: 2016 - DNA, 1547 bp, Homo sapiens
cagcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgaggctctgcccagtggtcagcaggttgaggaagattcaaatggcagccttgtctgaaatctccaagtaactcaagcttgcttgaggcttgagtcctgggctaactacctctgatcctctttgaccttccattacatacctaatcctagctgtctcctcatctcatcctagtctaggtttgcttgaaattgggtgtgagagctagaatgagaaaaagagtagcaaataatttgttttgccttgtgtgaacaccagtgcactggtggcttcctgagggactgaggtaagtctgccagaaaggtgaatagtgttagacaggcatacatttgccatcttttaaacagaatgactgatctaaagatgactcagcctgctttgaaattagcttgtagccatgaaagggccacccgattttccagtttaatgaaagctaacgtttattaagtactaaaattatatttattatgtataataaataagcacactgttataagca

SEQ ID NO: 2017 - DNA, 3747 bp, Homo sapiens
atggggaaggaccaggagctgctggaagctgctcgcactggaaatgtggctctggtggagaaactcctgtctggcaggaaaggagggatcctgggcggtggatccggacccctgcccctgtctaatctgctaagcatctggcgaggccccaatgtgaactgcacagacagttcgggttacactgctttacaccacgcagccttaaatggacataaggacatagttctcaaactacttcagtatgaggcatcaacaaatgtagcagacaacaaagggtattttcctattcacctggctgcctggaaaggagatgtggaaattgtgaagattcttattcatcatggaccatcacattccagggtcaatgaacagaacaatgaaaatgaaactgccctacactgtgcagctcaatatggacactcagaagtagttgctgttctcctagaagagctcactgacccgacaattagaaatagcaagctggaaacacctttggacttggcggcactctacggacggcttagagtggtaaaaatgatcatcagtgcacatcctaacttaatgagctgcaacactcgcaagcacacgccacttcaccttgctgcgcgcaatggccacaaagcagtcgtgcaggtgctgctggaggcaggaatggatgtgagctgtcaaacagaaaaggggagtgcacttcatgaagcagctttgtttggaaaggtggatgttgtacgagttctgttagaaacaggaattgatgccaacataaaggatagcttaggtagaactgtcttggacattctgaaagaacatccatctcagaaatctctccagattgcaacactcttacaagagtatttagaaggcgtgggaagatctacagtcctcgaagagcctgtacaggaagatgcaacacaagaaacacacatttcatctcctgttgagtctccttcccaaaagaccaaaagtgaaaccgtcactggagaattatcaaaactcttggatgaaataaaactctgtcaagaaaaggattattcgtttgaagacttgtgccacacaatatcagaccactacttagataatttgagcaagatttcagaggaagaacttgggaaaaatggaagccagagtgtaagaacctcatctacaatcaatttgtcaccaggagaagtggaagaagaggatgatgatgaaaatacgtgtgggccatcaggactttgggaagcattaactccgtgtaatggatgtaggaaccttggcttccccatgcttgcccaggagtcctatccaaagaagagaaattacactatggaaattgtaccatctgcttctctggatacatttccttcagaaaatgagaactttctgtgtgatctcatggacacagctgttacaaagaaaccttgctccttagaaattgcaagggcaccttccccaagaactgataatgcctctgaggtagcagttactactccaggaactagtaaccatagaaacagctcaacaggcccaacacctgattgttcacctccatcccctgatactgccctcaaaaatattgtaaaagtcattcgaccccagcctaaacagcgaacatccattgtgtcttctctggattttcaccgaatgaatcacaaccaagaatattttgaaatcaacacatctacagggtgcacaagctttactgccagtcctcctgctagtccacccacctcttctgtgggaaccacagaagtcaagaatgagggaactaaccatacagatgacctctcccgacaggatgacaatgatcccccaaaagaatatgatcctgggcaatttgcaggcctgctccatggatcctctccagcctgtgagtcccctgaaaatccatttcatctctatgggaaaagagaacaatgtgaaaaaggacaagatgaagtcagtttggcaaacagtcctttgcctttcaagcagtctccaatagaaaataactcagaacctttggtaaagaaaattaaacccaaagtggtcagtagaacaatttttcacaaaaaaagcaaccaactcgaaaaccataccattgttggcacaagatcaaccaggagtggatctcggaatggggaccagtgggttatgaacgcagggggatttgtggagagagcctgtactctggggagaataaggtcattgcctaaagccttgatcgacatgcatttgtcaaaaagtgtctctaaatctgattctgatctcattgcctatccttccaatgagaaaacatcaagagttaactggagtgaatcttccactgctgaacacagttctaaagggaattctgaaagaacaccatccttcacatcggaatgggaagaaattgacaaaataatgagttccatagatgttggaatcaacaacgaacttaaagagatgaatggtgagaccacaagacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggtaatgtgcgtgaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttga

SEQ ID NO: 2018 - DNA, 1353 bp, Homo sapiens
atgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggcaaatattcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctga

SEQ ID NO: 2019 - DNA, 1984 bp, Homo sapiens
attcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaacaaaatcctcctcttgaccgactgcatgaactgccatgaaatttgcagctccatcatactaggtatctcttctttcttcatgttaccttgtctttcttcccatttttcttttaagacagggtcttgctatgtcacccaggctggactcaaactccagggctcaaggaatcctcctgtcttagcctcccaaggagctgggattacaggcacgtgccaccgcacctggctcctaatttctttttaagacaagggccattcaaggctttttaaaacctgatgtgtgttgttatactttataacagtcagtggcttttaattccaaaaggtaatactttatactctgcctacatgagatgagcccctaacagtgtgtacaaataaaattatgatttgggtattctaaggagacataccatttacagaaatttcttttgataaaattaaggtttcacttttcacatttgcttaaatcacagtaagcctgtaaactagctccttgacccaccattt

SEQ ID NO: 2020 - DNA, 1053 bp, Homo sapiens
gttttgtttcagggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggcaaatattcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgatcgacccatctgagcaaaagactctggccaatctaccgtggattgtggagccgggccaagaagccaagaggggcattaataccaagtatgaaaccacgattttctga

SEQ ID NO: 2021 - DNA, 2292 bp, Homo sapiens
tcttttcaggagtcctatccaaagaagagaaattacactatggaaattgtaccatctgcttctctggatacatttccttcagaaaatgagaactttctgtgtgatctcatggacacagctgttacaaagaaaccttgctccttagaaattgcaagggcaccttccccaagaactgataatgcctctgaggtagcagttactactccaggaactagtaaccatagaaacagctcaacaggcccaacacctgattgttcacctccatcccctgatactgccctcaaaaatattgtaaaagtcattcgaccccagcctaaacagcgaacatccattgtgtcttctctggattttcaccgaatgaatcacaaccaagaatattttgaaatcaacacatctacagggtgcacaagctttactgccagtcctcctgctagtccacccacctcttctgtgggaaccacagaagtcaagaatgagggaactaaccatacagatgacctctcccgacaggatgacaatgatcccccaaaagaatatgatcctgggcaatttgcaggcctgctccatggatcctctccagcctgtgagtcccctgaaaatccatttcatctctatgggaaaagagaacaatgtgaaaaaggacaagatgaagtcagtttggcaaacagtcctttgcctttcaagcagtctccaatagaaaataactcagaacctttggtaaagaaaattaaacccaaagtggtcagtagaacaatttttcacaaaaaaagcaaccaactcgaaaaccataccattgttggcacaagatcaaccaggagtggatctcggaatggggaccagtgggttatgaacgcagggggatttgtggagagagcctgtactctggggagaataaggtcattgcctaaagccttgatcgacatgcatttgtcaaaaagtgtctctaaatctgattctgatctcattgcctatccttccaatgagaaaacatcaagagttaactggagtgaatcttccactgctgaacacagttctaaagggaattctgaaagaacaccatccttcacatcggaatgggaagaaattgacaaaataatgagttccatagatgttggaatcaacaacgaacttaaagagatgaatggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggtaatgtgcgtgaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttga

SEQ ID NO: 2022 - DNA, 1281 bp, Homo sapiens
atgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctga

SEQ ID NO: 2023 - DNA, 1383 bp, Homo sapiens
atgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcctttctgttttaaagcagatcgacccatctga

SEQ ID NO: 2024 - DNA, 2595 bp, Homo sapiens
ggcaaggactctgtgggggagtcggtgagagactatggggaaggaccaggagctgctggaagctgctcgcactggaaatgtggctctggtggagaaactcctgtctggcaggaaaggagggatcctgggcggtggatccggacccctgcccctgtctaatctgctaagagaacctcatctacaatcaatttgtcaccaggagaagtggaagaagaggatgatgatgaaaatacgtgtgggccatcaggactttgggaagcattaactccgtgtaatggatgtaggaaccttggcttccccatgcttgcccaggagtcctatccaaagaagagaaattacactatggaaattgtaccatctgcttctctggatacatttccttcagaaaatgagaactttctgtgtgatctcatggacacagctgttacaaagaaaccttgctccttagaaattgcaagggcaccttccccaagaactgataatgcctctgaggtagcagttactactccaggaactagtaaccatagaaacagctcaacaggcccaacacctgattgttcacctccatcccctgatactgccctcaaaaatattgtaaaagtcattcgaccccagcctaaacagcgaacatccattgtgtcttctctggattttcaccgaatgaatcacaaccaagaatattttgaaatcaacacatctacagggtgcacaagctttactgccagtcctcctgctagtccacccacctcttctgtgggaaccacagaagtcaagaatgagggaactaaccatacagatgacctctcccgacaggatgacaatgatcccccaaaagaatatgatcctgggcaatttgcaggcctgctccatggatcctctccagcctgtgagtcccctgaaaatccatttcatctctatgggaaaagagaacaatgtgaaaaaggacaagatgaagtcagtttggcaaacagtcctttgcctttcaagcagtctccaatagaaaataactcagaacctttggtaaagaaaattaaacccaaagtggtcagtagaacaatttttcacaaaaaaagcaaccaactcgaaaaccataccattgttggcacaagatcaaccaggagtggatctcggaatggggaccagtgggttatgaacgcagggggatttgtggagagagcctgtactctggggagaataaggtcattgcctaaagccttgatcgacatgcatttgtcaaaaagtgtctctaaatctgattctgatctcattgcctatccttccaatgagaaaacatcaagagttaactggagtgaatcttccactgctgaacacagttctaaagggaattctgaaagaacaccatccttcacatcggaatgggaagaaattgacaaaataatgagttccatagatgttggaatcaacaacgaacttaaagagatgaatggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttga

SEQ ID NO: 2025 - DNA, 3885 bp, Homo sapiens
atggggaaggaccaggagctgctggaagctgctcgcactggaaatgtggctctggtggagaaactcctgtctggcaggaaaggagggatcctgggcggtggatccggacccctgcccctgtctaatctgctaagcatctggcgaggccccaatgtgaactgcacagacagttcgggttacactgctttacaccacgcagccttaaatggacataaggacatagttctcaaactacttcagtatgaggcatcaacaaatgtagcagacaacaaagggtattttcctattcacctggctgcctggaaaggagatgtggaaattgtgaagattcttattcatcatggaccatcacattccagggtcaatgaacagaacaatgaaaatgaaactgccctacactgtgcagctcaatatggacactcagaagtagttgctgttctcctagaagagctcactgacccgacaattagaaatagcaagctggaaacacctttggacttggcggcactctacggacggcttagagtggtaaaaatgatcatcagtgcacatcctaacttaatgagctgcaacactcgcaagcacacgccacttcaccttgctgcgcgcaatggccacaaagcagtcgtgcaggtgctgctggaggcaggaatggatgtgagctgtcaaacagaaaaggggagtgcacttcatgaagcagctttgtttggaaaggtggatgttgtacgagttctgttagaaacaggaattgatgccaacataaaggatagcttaggtagaactgtcttggacattctgaaagaacatccatctcagaaatctctccagattgcaacactcttacaagagtatttagaaggcgtgggaagatctacagtcctcgaagagcctgtacaggaagatgcaacacaagaaacacacatttcatctcctgttgagtctccttcccaaaagaccaaaagtgaaaccgtcactggagaattatcaaaactcttggatgaaataaaactctgtcaagaaaaggattattcgtttgaagacttgtgccacacaatatcagaccactacttagataatttgagcaagatttcagaggaagaacttgggaaaaatggaagccagagtgtaagaacctcatctacaatcaatttgtcaccaggagaagtggaagaagaggatgatgatgaaaatacgtgtgggccatcaggactttgggaagcattaactccgtgtaatggatgtaggaaccttggcttccccatgcttgcccaggagtcctatccaaagaagagaaattacactatggaaattgtaccatctgcttctctggatacatttccttcagaaaatgagaactttctgtgtgatctcatggacacagctgttacaaagaaaccttgctccttagaaattgcaagggcaccttccccaagaactgataatgcctctgaggtagcagttactactccaggaactagtaaccatagaaacagctcaacaggcccaacacctgattgttcacctccatcccctgatactgccctcaaaaatattgtaaaagtcattcgaccccagcctaaacagcgaacatccattgtgtcttctctggattttcaccgaatgaatcacaaccaagaatattttgaaatcaacacatctacagggtgcacaagctttactgccagtcctcctgctagtccacccacctcttctgtgggaaccacagaagtcaagaatgagggaactaaccatacagatgacctctcccgacaggatgacaatgatcccccaaaagaatatgatcctgggcaatttgcaggcctgctccatggatcctctccagcctgtgagtcccctgaaaatccatttcatctctatgggaaaagagaacaatgtgaaaaaggacaagatgaagtcagtttggcaaacagtcctttgcctttcaagcagtctccaatagaaaataactcagaacctttggtaaagaaaattaaacccaaagtggtcagtagaacaatttttcacaaaaaaagcaaccaactcgaaaaccataccattgttggcacaagatcaaccaggagtggatctcggaatggggaccagtgggttatgaacgcagggggatttgtggagagagcctgtactctggggagaataaggtcattgcctaaagccttgatcgacatgcatttgtcaaaaagtgtctctaaatctgattctgatctcattgcctatccttccaatgagaaaacatcaagagttaactggagtgaatcttccactgctgaacacagttctaaagggaattctgaaagaacaccatccttcacatcggaatgggaagaaattgacaaaataatgagttccatagatgttggaatcaacaacgaacttaaagagatgaatggtgagaccacaagacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaa

SEQ ID NO: 2026 - DNA, 2973 bp, Homo sapiens
gggtaatgaaggggagcgagcgagggggagcaaggagcatggagctgcatactgatgagtgacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 2027 - DNA, 3328 bp, Homo sapiens
attgctcattgtggagtactccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaa

SEQ ID NO: 2028 - DNA, 2268 bp, Homo sapiens
ctccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaacaaaatcctcctcttgaccgactgcatgaactgccatgaaatttgcagctccatcatactaggtatctcttctttcttcatgttaccttgtctttcttcccatttttcttttaagacagggtcttgctatgtcacccaggctggactcaaactccagggctcaaggaatcctcctgtcttagcctcccaaggagctgggattacaggcacgtgccaccgcacctggctcctaatttctttttaagacaagggccattcaaggctttttaaaacctgatgtgtgttgttatactttataacagtcagtggcttttaattccaaaaggtaatactttatactctgcctacatgagatgagcccctaacagtgtgtacaaataaaattatgatttgggtattctaa

SEQ ID NO: 2029 - DNA, 3372 bp, Homo sapiens
ctccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 2030 - DNA, 1690 bp, Homo sapiens
gtaacgtataaccagtatgaagattcaattcagatttaagcactttggtttgcttttgaatcttgctattttctgcatttgttttgactgctctcatcattcaagattgacgcttggatgggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcct

SEQ ID NO: 2031 - DNA, 2906 bp, Homo sapiens
ctgcctggagagacatctggccaagttctggtgagcaggaaaaatgtctactcgttaccaccaagctgctagtgatagttacctggaacttctaaaagaggctaccaagcgagatctaaatctttcggatgaagacggcatgactcctactctcttggcagcctaccatgggaacttggaagccctagagataatctgcagtagaggaggggaccctgataggtgtgacatctggggaaacactcctctacattttgcagcctccaatggccatgcccactgcgtctcattcctggtcaactttggtgccaacatctttgccctggataatgacttacagactccactggatgctgctgccagcagggagcagaatgaatgtgttgctctcctggacaaggctgccactgcacagaacatcatgaaccccaagaaggtcaccaggctgaaggagcaggctcagaagaatgccaggaggcagatcaaagagtgtgagaggctccaggagaagcaccaaaataagatggcccacacctacagcaaggaggaatccgggactctctcttcttccaagggtaccttctccagatcatccccttcaaatgcttctgctcctggcacattcgggtcactatctaagggcattaaagacactttcaagatcaagttcaagaagaacaaagatacagcagaacaggtggggaaggaaggcagaagtgggcagaggaacgtgatggaagtgttcagagaggaagaggaagactcgttctcaggggacttcaaagagaagctccagttgtcagcagaggaggacggcagtgtgcaccatgaatccattctcaatcgtccaggtctaggaagtattgtttttagaaggaacaggatatcgagtcctgaagacatctcagatagcaagagagagtttggttttaaactgcccagtgaattgcttcaaagacaaggagcatcagaggctgatgagggtgcagctgatgaagagggagaggaaaacggcctcaaagatgatctgccgtgggatgacgatgaagtggagtgggaggaagatgtggtcgatgccacgcccctggaagtgttcttgctgtctcagcacctggaagaattcctgcctatcttcaagagagagcagattgatctagaagctctgctgctctgctctgatgaggaccttcagagcatacaaatgcagctgggtcccaggaagaaagttctgaatgctatcaacaggaggaagcaggtgcttcaacagcctgggcagctggtcgacaccagcctgtgatggagagttttggcctggagcattggggtgatgctgtggcccgctggcagcactccaggcggcaccccctctttacccaatgccagaccactgggaatggattctagggcatcggaaatgcctacctgagagagagacccaaactttactctgggaggtaggctatgcccatccaaataaatctccatgagaaacttgaggagacttcataacaagaatctggcatttctcttcagttatcttatatgtacatataattgtttttgtggttgttttgttttgttttgttttgttttttggagatgaaggtctcagtctcttacccaggctagggtgcagtggtatgatcatagttcactgtattctcaacctcctgggctcaaatgatctcctcccacctcagcctcccaagtagctgagactacaggttcacaccccccacacctggcttattttgtatgttttagtagaggtggggtcttgccacattgcccaggctggtctcaaactcctggcctcaagcaatcctcccacctcagcctcctaaagcactgggattacaggtgtgaaccaccgtacccagcctatctttttgatacttttgaataaagaaagggtcatatgcatgacaggaaaatgaaagaaacttcctttacttttctatctctggatttaaaattataatctcatcacattatcctgctgcttgctttccgatctgtgtaacctgggaattccaattctttttctctcctgagatctatgactttgcctagtggtagagactagagttctttcctggcctgcggcttgatgcccaacttaaatgcatctaaccctttaacaaatgtgtacatgtttacaagtaatggaaatgcgtctataatactcctgcctgagaatagagacagagtggtggtggggagagtgaagaaagagatagaatacaggtggtacctgttgtggactgaattgcgtcaaattcatatgttggagctctaacccctaatgtgactgtaattggaaataagacctttaaagaagtgattaaggttaaatgaagtcataagaatgcaaccctaatcctgtaggactggtgtcctttttttccctttttttttttttttttgagatggagccttgctctgtcactcatgctggagtgcagtggcgtgatctcagctcactgcaacccccgcctcccaggttcgagcacttttcatgcctcagcctcctgagtagctgggattacaggcgtgcaccacaacgcctggctaagtttttgtatttttagtagaggcggggtttcaccatgttggccaggctggtctcaaactcctgacctcaggtgatccacctgcctcggcctcccagagtgctgggattacaggcatgagccactgcacctggcctaggactggtgtcctaagaagaggaagagacacttaggtggaaggcacacagagaggccacgtgaggacacagtgagaaggtggccgtctgcaagccgaggagggggcctcaggagaaaccaaccctgcaatcaccttgatcttgggctttcagcccccaaaggtgtgagaaaataaacttcggttgataaactgct

SEQ ID NO: 2032 - DNA, 9304 bp, Homo sapiens
agaggccgccctgagacggtgcgcgatggaccgagggccccagccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaaacgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagaccgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggcgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcctaaaagagaagaagaagagagagaaacacagggagaaatggagagacgagaaggagaggcaccgggacaggcatgcggatgggctgctgcggcatcacagggacgagctcctgcggcatcacagggacgagcagaagcccgccaccagggacaaggacagcccgccccgcgtgctcaaagacaagtccagggacgagggcccgaggctcggcgatgccaaactgaaggagaaattcaaggacggtgcagagaaagaaaagggcgacccagtgaagatgagcaacgggaatgataaggtagcgccatccaaagacccaggcaagaaagacgccaggcccagggagaagctcctgggggacggcgacctgatgatgaccagcttcgagaggatgctgtcccagaaggacctggagatcgaggagcgccacaagcggcacaaggagaggatgaagcaaatggagaagctgaggcaccggtccggagaccccaagctcaaggagaaggcgaagccggcagacgacgggcggaagaagggtctggacattcctgctaagaaaccgccggggctggaccctccatttaaagacaaaaagctcaaagagtcgactcctattccacctgccgcggaaaataagctacacccagcatcaggtgcagactccaaagactggctggcaggccctcacatgaaagaggtcctgcctgcgtcccccaggcctgaccagagccggcccactggcgtgcccacccctacgtcggtgctatcctgccccagctacgaggaggtgatgcacacgcccaggaccccgtcctgcagcgccgatgactacgcggacctcgtgttcgactgcgccgactcgcagcactccacgcccgtgcccaccgctcccaccagcgcctgctccccctcctttttcgacaggttctccgtggcttcaagtgggctttcggaaaacgccagccaggctcctgccaggcctctctccacaaacctttaccgctcggtctctgtcgacattaggaggacccccgaggaagaattcagcgtcggagacaagctcttcaggcagcagagcgttcctgctgcctccagctacgactctcccatgccaccctcgatggaagacagggcgcccctgcccccggttcccgcggagaagtttgcctgcttgtcgccagggtactactccccagactatggcctcccgtcgcccaaagtcgacgctttgcactgcccaccggctgccgttgtcactgtcaccccgtctccagagggcgtcttctcaagtttacaagcaaaaccttccccttcccccagagccgagctgctggttccttccctcgaaggggcccttcccccggacctggacacctccgaggaccagcaggcgacggccgccatcatccccccggagcccagctacctggagccgctggacgagggtcccttcagcgccgtcatcaccgaggagcccgttgagtgggcccacccctccgagcaggcgcttgcctctagcctgatcgggggcacctctgaaaaccctgtgagctggcctgtgggctcggacctcctgctgaagtctccacagagattccccgagtccccaaagcgtttctgccccgcggaccccctccactctgccgccccagggcccttcagcgcctcggaggcgccgtaccccgcccctcccgcctctcctgccccgtacgctctgcccgtcgctgagccggggctggaggacgtcaaggacggagtggacgccgtccccgccgccatctccacctcagaggcggctccctacgcccctccctccgggctggagtccttcttcagcaactgcaagtcacttccggaagccccgctggacgtggcccccgagcccgcctgtgtagccgctgtggctcaggtggaggctctggggcccctggaaaatagcttcctggacggcagccgcggcctgtctcacctcggccaggtggagccggtgccctgggcggacgccttcgccggccccgaggacgacctggacctggggcccttctccctgccggagcttcccctgcagactaaagatgccgcagatggtgaagcggaacccgtggaagaaagtcttgctcctccagaagagatgcctccaggggcccccggggtcataaacggtggggatgtttccaccgtagtggctgaggagccgccggcactgcctcctgaccaggcctccacccggctccctgcagagctcgagcctgagccctcaggggagccaaagctggacgtggctctagaagctgcggtggaggcggagacggtgccggaagagagggcccgtggggatccggactccagcgtggagcccgcgcccgttcccccagaacagcgcccactggggagcggagaccagggggctgaggctgaaggcccccccgccgcgtccctctgtgcccctgacggccccgccccgaacactgtggcacaagctcaggccgcagacggtgccggccccgaggacgacactgaggcctcccgtgccgccgccccagccgaaggccctcctggcggcatccagccggaagccgcagaaccaaaacccacggccgaagccccgaaggccccccgagtggaggagatccctcagcgcatgaccaggaaccgggcgcagatgctcgcgaaccagagcaagcagggcccgcccccctccgagaaggagtgcgcccccacccctgccccggtcaccagggccaaggcccgcggctccgaggacgacgacgcccaggcccagcatccgcgcaaacgccgctttcagcgctccacccagcagctgcagcagcagctgaacacgtccacgcagcagacgcgggaggtgatccagcagacgctggccgccatcgtggacgccatcaagctggatgccatcgagccctaccacagcgacagggccaacccctacttcgaatacctgcagatcaggaagaagatcgaggagaagcgcaagatcctgtgctgtatcacgccgcaggcgccccagtgctacgccgagtacgtcacctacacgggctcctacctcctggacggcaagccgctcagcaagctccacatccccgtgatcgcaccccctccctccctggcggagcccctgaaggagctgttcaggcagcaggaggccgtccggggaaagctgcgtctacagcacagcatcgagcgggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccagggtgacgagaacaagtcagtgcgcgaccgtttcaacgcccgccagttcatctcctggctccaggacgtggatgacaagtatgaccgcatgaagacttgcctcctcatgcggcagcagcacgaggccgcggccctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcacttggccacagcgcctccatcccttccagactggtccagacgtcggggaggtgaaacacgtctcttctctaccagctgccgcggcgggggcaaagcccccagagcctcactggccccggcgggatgaggagaccatgccgggcgcgcacacacggcagcttctgtttgaaaacggcgaccttcgggcccttttctccagcaactgcagaggcatttcaggagttggagaacggagtacatttttaaaattttttgttccattctgatcaactaaagaaaattaaggtgtccacctctcacaaacagtgacctgcaggtcggaggggcaggagccccatcccagccgtggttctgttgccgccgagctgcgacggcctcagactgggcttcagacctggtgcggagccaggcggagggacacagagccaggactcccagccgtattgaaatggagtcaaatccgcgtggtttgtatcttctttcctttaatcttgggcattttgtttctctttctgagaacgtaacttgaaacactacagagccaataatcatataaaaagtgtatccgtaaacgctgtacagttttatataccttcacaatgtacttttgctgccttctagataatttattttgcaacacattactgcacagttgtaaataacttatgtactgtaacatcactttcagttatgtgtaaagaaataaataaattaattaaaatgc

SEQ ID NO: 2033 - DNA, 1833 bp, Homo sapiens
tctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagaccgaaaagcataaaagtgtccctggctacctttcggaaaagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaag

SEQ ID NO: 2034 - DNA, 9129 bp, Homo sapiens
ggccgcgggctgcatgggcagcgcccgcgccccgccgctgagccgtcgcggagccgcgcagccctcggagcacgcccgtgcagcctgccaggactcttccagacacgggatttgtcggtgaacaacgcagagctgatgcagacataatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagaccgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggcgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcctaaaagagaagaagaagagagagaaacacagggagaaatggagagacgagaaggagaggcaccgggacaggcatgcggatgggctgctgcggcatcacagggacgagctcctgcggcatcacagggacgagcagaagcccgccaccagggacaaggacagcccgccccgcgtgctcaaagacaagtccagggacgagggcccgaggctcggcgatgccaaactgaaggagaaattcaaggacggtgcagagaaagaaaagggcgacccagtgaagatgagcaacgggaatgataaggtagcgccatccaaagacccaggcaagaaagacgccaggcccagggagaagctcctgggggacggcgacctgatgatgaccagcttcgagaggatgctgtcccagaaggacctggagatcgaggagcgccacaagcggcacaaggagaggatgaagcaaatggagaagctgaggcaccggtccggagaccccaagctcaaggagaaggcgaagccggcagacgacgggcggaagaagggtctggacattcctgctaagaaaccgccggggctggaccctccatttaaagacaaaaagctcaaagagtcgactcctattccacctgccgcggaaaataagctacacccagcatcaggtgcagactccaaagactggctggcaggccctcacatgaaagaggtcctgcctgcgtcccccaggcctgaccagagccggcccactggcgtgcccacccctacgtcggtgctatcctgccccagctacgaggaggtgatgcacacgcccaggaccccgtcctgcagcgccgatgactacgcggacctcgtgttcgactgcgccgactcgcagcactccacgcccgtgcccaccgctcccaccagcgcctgctccccctcctttttcgacaggttctccgtggcttcaagtgggctttcggaaaacgccagccaggctcctgccaggcctctctccacaaacctttaccgctcggtctctgtcgacattaggaggacccccgaggaagaattcagcgtcggagacaagctcttcaggcagcagagcgttcctgctgcctccagctacgactctcccatgccaccctcgatggaagacagggcgcccctgcccccggttcccgcggagaagtttgcctgcttgtcgccagggtactactccccagactatggcctcccgtcgcccaaagtcgacgctttgcactgcccaccggctgccgttgtcactgtcaccccgtctccagagggcgtcttctcaagtttacaagcaaaaccttccccttcccccagagccgagctgctggttccttccctcgaaggggcccttcccccggacctggacacctccgaggaccagcaggcgacggccgccatcatccccccggagcccagctacctggagccgctggacgagggtcccttcagcgccgtcatcaccgaggagcccgttgagtgggcccacccctccgagcaggcgcttgcctctagcctgatcgggggcacctctgaaaaccctgtgagctggcctgtgggctcggacctcctgctgaagtctccacagagattccccgagtccccaaagcgtttctgccccgcggaccccctccactctgccgccccagggcccttcagcgcctcggaggcgccgtaccccgcccctcccgcctctcctgccccgtacgctctgcccgtcgctgagccggggctggaggacgtcaaggacggagtggacgccgtccccgccgccatctccacctcagaggcggctccctacgcccctccctccgggctggagtccttcttcagcaactgcaagtcacttccggaagccccgctggacgtggcccccgagcccgcctgtgtagccgctgtggctcaggtggaggctctggggcccctggaaaatagcttcctggacggcagccgcggcctgtctcacctcggccaggtggagccggtgccctgggcggacgccttcgccggccccgaggacgacctggacctggggcccttctccctgccggagcttcccctgcagactaaagatgccgcagatggtgaagcggaacccgtggaagaaagtcttgctcctccagaagagatgcctccaggggcccccggggtcataaacggtggggatgtttccaccgtagtggctgaggagccgccggcactgcctcctgaccaggcctccacccggctccctgcagagctcgagcctgagccctcaggggagccaaagctggacgtggctctagaagctgcggtggaggcggagacggtgccggaagagagggcccgtggggatccggactccagcgtggagcccgcgcccgttcccccagaacagcgcccactggggagcggagaccagggggctgaggctgaaggcccccccgccgcgtccctctgtgcccctgacggccccgccccgaacactgtggcacaagctcaggccgcagacggtgccggccccgaggacgacactgaggcctcccgtgccgccgccccagccgaaggccctcctggcggcatccagccggaagccgcagaaccaaaacccacggccgaagccccgaaggccccccgagtggaggagatccctcagcgcatgaccaggaaccgggcgcagatgctcgcgaaccagagcaagcagggcccgcccccctccgagaaggagtgcgcccccacccctgccccggtcaccagggccaaggcccgcggctccgaggacgacgacgcccaggcccagcatccgcgcaaacgccgctttcagcgctccacccagcagctgcagcagcagctgaacacgtccacgcagcagacgcgggaggtgatccagcagacgctggccgccatcgtggacgccatcaagctggatgccatcgagccctaccacagcgacagggccaacccctacttcgaatacctgcagatcaggaagaagatcgaggagaagcgcaagatcctgtgctgtatcacgccgcaggcgccccagtgctacgccgagtacgtcacctacacgggctcctacctcctggacggcaagccgctcagcaagctccacatccccgtgatcgcaccccctccctccctggcggagcccctgaaggagctgttcaggcagcaggaggccgtccggggaaagctgcgtctacagcacagcatcgagcgggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccagggtgacgagaacaagtcagtgcgcgaccgtttcaacgcccgccagttcatctcctggctccaggacgtggatgacaagtatgaccgcatgaagacttgcctcctcatgcggcagcagcacgaggccgcggccctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcacttggccacagcgcctccatcccttccagactggtccagacgtcggggaggtgaaacacgtctcttctctaccagctgccgcggcgggggcaaagcccccagagcctcactggccccggcgggatgaggagaccatgccgggcgcgcacacacggcagcttctgtttgaaaacggcgaccttcgggcccttttctccagcaactgcagaggcatttcaggagttggagaacggagtacatttttaaaattttttgttccattctgatcaactaaagaaaattaaggtgtccacctctcacaaacagtgacctgcaggtcggaggggcaggagccccatcccagccgtggttctgttgccgccgagctgcgacggcctcagactgggcttcagacctggtgcggagccaggcggagggacacagagccaggactcccagccgtattgaaatggagtcaaatccgcgtggtttgtatcttctttcctttaatcttgggcattttgtttctctttctgagaacgtaacttgaaacactacagagccaataatcatataaaaagtgtatccgtaaacgctgtacagttttatataccttcacaatgtacttttgctgccttctagataatttattttgcaacacattactgcacagttgtaaataacttatgtactgtaacatcactttcagttatgtgtaaagaaataaataaattaattaaaa

SEQ ID NO: 2035 - DNA, 1736 bp, Homo sapiens
agaggccgccctgagacggtgcgcgatggaccgagggccccagccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaaacgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggagaaagttacactaaaaataacacgattgcaccaaagaaagcgtcccatcgtatcctgtcagacacgtcggacgaggaggacgcgagtgtcaccgtggggacaggagagaagctga

SEQ ID NO: 2036 - DNA, 9069 bp, Homo sapiens
aatcgcggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagattcagatccaggacatacaagtgaaaattggggggagagacttatatcttcttacaggacatactcagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaa

SEQ ID NO: 2037 - DNA, 2241 bp, Homo sapiens
ttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagaatatttattttccacatggtgaatgtgcctgaattattgcttggtcaaagtccctcaaggaatgatacaaaaatcatcaattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatc

SEQ ID NO: 2038 - DNA, 10459 bp, Homo sapiens
gtgctcgcgtcgcagccaatcgcggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaagagtgaaatgtgtgctaactgtttttttacttaattttacttgggcagctagcaaaattgcagaaatatgcatcctgggaaaagaaacagcctttgaagaattagcctttcaagttcaaatctatttaataatgagaagtctcacaagtgaatttttaagtacaggcatacctcagacgtactttaggttccagaccatctcagtaaagcaaataccacaacaaagcgagtcaggaggaattttttggtttcccagtgcatataaaagttttgtttatactatattaagtgtgcaatagcattatgtctaaaaatatgtacataagtttaaaaatattttattgctaaaaatggtaacaaagtgagcacatgctgttggaaaaagagcaccaatagacttgcttgaagcagggttgccacaaaccttcaatttgtaaaaaacgccaatatgtacaaagcacaataaagcaaagcacaatagaacaggattgcctgtattagacatgctacaaacttcataactggaaacatctcaaagaccccatgaagctcatttgaatgggacttaacaattagacagttattttagaaattgagtgcagacctaaatacatagttttccaaaaagaaaattattgtctctgatatcttaaaacataaaaacccaaaattttatatagaagaaattgactctgtaaaacgcaatgaaatagtcctctttttaaacagtttaaaggaagcattttcaccgtttgtaaaaattatttttaaatatttagggcaaaatttttgttagataataatggaaaagcttgtgtgagtttagtggttaaaatatcttgtaattcatcattatttaagtgacttcttgggagccgtctttgtacctaaaatggagtttttttttaagcctccacagagatagtcacccaaagtatttccagtcagtaaaagtagaattcatagaaaaaactgaggcaaattaaaacaattccattaatcaaaatggctttaaacaaattaagtattagcataaaaatagcaaaaagtacaactaaaaaaatggttgggttttcccagtggttaaatgctatataataactgcaaataaaagtttttttgtacatggacagcgtcctcataaaagaaaataggccaggccaggcgcagtggctcgcgcctgtaatcccagcactttgggaggccaaggcgggcggatcacgaggtcaggagatcgagaccatcctggctaacacggtgaaaccccgtctctactaaacaaaatgcaaaaaatcagccgggtgtggccgcgggcgcctgtagttccagctactcgggaggctgaggcaggagaatggcgtgagcctgggaggcggagcttgcagtgagccgagatcgtgccactgcactccagcctgggcgacagagcgagactccgtctc

SEQ ID NO: 2039 - DNA, 451 bp, Homo sapiens
actgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggagggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagggacaagctatattcgcatcacacagaaaaatgccataaagaaggtgagaagagcaaaaatactgctgctattaaaaaaactgacgacagagagaaaagtagagaaaa

SEQ ID NO: 2040 - DNA, 1313 bp, Homo sapiens
gaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagattcagatccaggacatacaagtgaaaattggggggagagacttatatcttcttacaggacatactcagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacaggatccagctaccaatttgcaggaaatgccaagctcagcggagcaagttgaactataccaagtgtatgcaatcagcaaattccagattgtgagaaagccaaacagccttggttctttaacagatattttgtgtggaaaagaaacagaagaagaccatgt

SEQ ID NO: 2041 - DNA, 1370 bp, Homo sapiens
gtgctcgcgtcgcagccaatcgcggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaaaagaaaaggaaggaaaagaaa

SEQ ID NO: 2042 - DNA, 1385 bp, Homo sapiens
ggctggagcatgcagccagcagttcccttttgcaactcagttgccttggctaaggcccaaccagtcccaagtgctcaggacagaggctggacgggctccttcctgcacccctgctcttgggacacagtgccctccggctctaataggccaggagttgggggggcaactggctctgctccctggccctggctccccctgctccctggggctgcccgaggtgaaggtgacaggtgggggaggcaggtggagaattgggccagtgagctcatggcaaaggcgcccagctgggcaggggtgggtgctctggcctataaagcccccgaggccctgtggcctgcagaggcggttatggacggcaccatggaggactccgaggcggtgcagagggccacagcgctcatcgagcagcggctggcacaggaggaggagaatgagaaactccgaggagacgcacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttccaggatcggctggactgcacagccatgcattgggcctgccgcgggggccacttagaggtggtgaaacttctgcaaagccatggagcagacaccaatgtgagggataaggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactacc

SEQ ID NO: 2043 - DNA, 1484 bp, Homo sapiens
ggctggagcatgcagccagcagttcccttttgcaactcagttgccttggctaaggcccaaccagtcccaagtgctcaggacagaggctggacgggctccttcctgcacccctgctcttgggacacagtgccctccggctctaataggccaggagttgggggggcaactggctctgctccctggccctggctccccctgctccctggggctgcccgaggtgaaggtgacaggtgggggaggcaggtggagaattgggccagtgagctcatggcaaaggcgcccagctgggcaggggtgggtgctctggcctataaagcccccgaggccctgtggcctgcagaggcggttatggacggcaccatggaggactccgaggcggtgcagagggccacagcgctcatcgagcagcggctggcacaggaggaggagaatgagaaactccgaggagacgcacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttccaggatcggctggactgcacagccatgcattgggcctgccgcgggggccacttagaggtggtgaaacttctgcaaagccatggagcagacaccaatgtgagggataagctgctgagcaccccgctgcacgtggcagtccggacagggcaggtggagattgtggagcactttctatccctgggcctggaaatcaatgccagagacagggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactacc

SEQ ID NO: 2044 - DNA, 1451 bp, Homo sapiens
aaccagtcccaagtgctcaggacagaggctggacgggctccttcctgcacccctgctcttgggacacagtgccctccggctctaataggccaggagttgggggggcaactggctctgctccctggccctggctccccctgctccctggggctgcccgaggtgaaggtgacaggtgggggaggcaggtggagaattgggccagtgagctcatggcaaaggcgcccagctgggcaggggtgggtgctctggcctataaagcccccgaggccctgtggcctgcagaggcggttatggacggcaccatggaggactccgaggcggtgcagagggccacagcgctcatcgagcagcggctggcacaggaggaggagaatgagaaactccgaggagacgcacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttccaggatcggctggactgcacagccatgcattgggcctgccgcgggggccacttagaggtggtgaaacttctgcaaagccatggagcagacaccaatgtgagggataagctgctgagcaccccgctgcacgtggcagtccggacagggcaggtggagattgtggagcactttctatccctgggcctggaaatcaatgccagagacagggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactaccacaataaaaaagctgtttttgctaa

SEQ ID NO: 2045 - DNA, 1072 bp, Homo sapiens
agaggcggttatggacggcaccatggaggactccgaggcggtgcagagggccacagcgctcatcgagcagcggctggcacaggaggaggagaatgagaaactccgaggagacgcacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttccaggatcggctggactgcacagccatgcattgggcctgccgcgggggccacttagaggtggtgaaacttctgcaaagccatggagcagacaccaatgtgagggataaggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactaccacaataaaaaagctgtttttgctaa

SEQ ID NO: 2046 - DNA, 2597 bp, Homo sapiens
ttcagctcttctcactggggggtgtgaggaacaggggggaccatggacttcatcagcattcagcagttggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagccgcagtcccaggcccaggtggagcctgtgggcctggagatgttcctgaaggcagctgctgagaaccaggagtacctgattgacaagtacttgacagacggaggggaccccaatgcccatgacaagctccaccgcaccgccttgcactgggcctgtctgaagggtcacagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcacaggataaggaaggggacacggctctgcacgaggccgtgcggcacggcagctacaaagccatgaagctactgctgctctatggggccgagctgggggtgcggaacgcggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgccccccagcccttcccatcccttccctgctccctggtggtctaaggacccaagctccctagacttcctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattaca

SEQ ID NO: 2047 - DNA, 2455 bp, Homo sapiens
actggggggtgtgaggaacaggggggaccatggacttcatcagcattcagcagttggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagctccaccgcaccgccttgcactgggcctgtctgaagggtcacagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcacaggataaggaaggggacacggctctgcacgaggccgtgcggcacggcagctacaaagccatgaagctactgctgctctatggggccgagctgggggtgcggaacgcggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgccccccagcccttcccatcccttccctgctccctggtggtctaaggacccaagctccctagacttcctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccatt

SEQ ID NO: 2048 - DNA, 2156 bp, Homo sapiens
aacaggggggaccatggacttcatcagcattcagcagttggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagccgcagtcccaggcccaggtggagcctgtgggcctggagatgttcctgaaggcagctgctgagaaccaggagtacctgattgacaagtacttgacagacggaggggaccccaatgcccatgacaagctccaccgcaccgccttgcactgggcctgtctgaagggtcacagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcacaggataaggaaggggacacggctctgcacgaggccgtgcggcacggcagctacaaagccatgaagctactgctgctctatggggccgagctgggggtgcggaacgcggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccatta

SEQ ID NO: 2049 - DNA, 5278 bp, Homo sapiens
atgaatcatatgtttcacataaaaaggcatagtatttctgctggtacagacgcttacaagaaaacaaaaccaatacagaacttgttccagaagccattatatgatcattgcagtgctaataactataaaagcatggaacctgaattagaaaatgtgaggtcttctccaccacgtggtgacagaacatcaaaagtatctctaaaagaagaattacagcaagatatgcaaaggtttaaaaatgagataggcatgttaaaagtagagttccaggctttggagaaagaaaaagtccaacttcaaaaagaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgttatattttgacaacttcagacttacagaaagattataagaggtagtacaaataatttttggatattattccccaaatgttaacattttactgcatttactttatcctttctcccccttctcctcctgtctttctagatgaatatgaatataggtacttaatacagattttttttctaaactgtt

SEQ ID NO: 2050 - DNA, 6591 bp, Homo sapiens
gtctagcgggatcgcttgcttggtaacccggagggagagattggaaaccgcggagtttcctttgggaggctgcggccagccggggctgacttgttatgttgggctccggaggccgttaagagccgagagagacatgaggtgtctctgaagcccggtcgcctgggccatgaagaagatttttagtaagaagggcgagtcgcccttgggctccttcgcgcggcggcagaggagcagcgcgggaggcgggggcgagccgggggagggcgcctactcgcagcccggctaccacgtccgagaccgagatctcggcaagatccacaaagctgccagcgcgggtaatgtggcgaaagtgcagcagatccttttgctcaggaagaatggcttgaacgatagagacaagatgaacaggacggctctacatttggcctgtgccaatggtcatccagaagtagtaactctcctggtggacagaaaatgccagctcaatgtctgtgacaacgaaaacaggacagctctgatgaaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggatgacctcacaccacttttacttgcagtaagtggaaaaaagcagcaaatggtggaatttttaataaagaaaaaagcaaatgtaaatgcagtagataagttggaaagcagtcaccaactaatttcagaatataaagaagaaaggatacctaaacattcttctcaaaatagtaattcagtggatgaaagctctgaagactccttaagcaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagatgtgttttatataccttcttgcatgagtggatcaagaaactttaagatggctaaactagaggatacaagaaatgtaggcatgccagtagcccacatggagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgtta

SEQ ID NO: 2051 - DNA, 5287 bp, Homo sapiens
ggctccggaggccgttaagagccgagagagacatgaggtgtctctgaagcccggtcgcctgggccatgaagaagatttttagtaagaagggcgagtcgcccttgggctccttcgcgcggcggcagaggagcagcgcgggaggcgggggcgagccgggggagggcgcctactcgcagcccggctaccacgtccgagaccgagatctcggcaagatccacaaagctgccagcgcgggtaatgtggcgaaagtgcagcagatccttttgctcaggaagaatggcttgaacgatagagacaagatgaacaggacggctctacatttggcctgtgccaatggtcatccagaagtagtaactctcctggtggacagaaaatgccagctcaatgtctgtgacaacgaaaacaggacagctctgatgaaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggatgacctcacaccacttttacttgcagtaagtggaaaaaagcagcaaatggtggaatttttaataaagaaaaaagcaaatgtaaatgcagtagataagttggaaagcagtcaccaactaatttcagaatataaagaagaaaggatacctaaacattcttctcaaaatagtaattcagtggatgaaagctctgaagactccttaagcagtttattttattttattttttttgagacaaagtcttgcactgttgcccaggctggagtgctacagcatgatctcagctcactgcaatctctgcttcctgggttcacacaattcttctgcctccacctcccaagtagctgggaccacaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttg

SEQ ID NO: 2052 - DNA, 761 bp, Homo sapiens
gtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatggaccttctgatgaaacccctcatgactatgttctgatgactgaccaatgtctcacttccaggacagacctgcaatagatgccactggataatgctgagatagactggtgcaggacaaaggacagaactcaaagtcatccctctgctgacctgagacaaatgtgtatctgagtgcttcctccgccctattgtctatgtc

SEQ ID NO: 2053 - DNA, 6295 bp, Homo sapiens
atgagtcgagtgtgtattgttgttttggaggaggtagaagatgaatctcctgcattcatttctaaattgccacaggaaaataaatccctacattctccaccttctggaaatgtattggtaagatatccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggattttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaatgaataatgtatttgtatctgtgcatattatctacaaatctataaagtttctagggcattgactactagattttaagcattttttctaaaatatttacagaaattataaatctaatcccccatcttttctttataatataaagaagtcataatgaacccttcctaattattagtagtaggaaggtgaatatgcattttaatgacagtggactacattttctattgtaccttttgaaaaaaaaaaaaatcaagcagattctaaaagtatacatatgtgtgctttctctttccttttaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaa

SEQ ID NO: 2054 - DNA, 6564 bp, Homo sapiens
gcggccgcgggggctgccagggtatttcgggaagggggcgtgaggaggcggcggcggcagcggcgggtagggcaggcagcagagggaaggagaaagaaaggaaggaagagggcggggagtcctcagaggaggaggcgggaccggccgggcacctcacctctcggcggcggcggcggcggcggcggcggcgggcggccggggaggcggcgccgccccctgcccgcaggtcttctcagcgcagtcggccgcggacccgctggtcccgggcagcggccaaggctactggggcgggagcagtgggccggtcggcggcggcagcggcagcggcggaggaggaggaggctggagtgggcgcggaggcgaccgccatggcgttcctcaaactccgtgaccagccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggattttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaatgaataatgtatttgtatctgtgcatattatctacaaatctataaagtttctagggcattgactactagattttaagcattttttctaaaatatttacagaaattataaatctaatcccccatcttttctttataatataaagaagtcataatgaacccttcctaattattagtagtaggaaggtgaatatgcattttaatgacagtggactacattttctattgtaccttttgaaaaaaaaaaaaatcaagcagattctaaaagtatacatatgtgtgctttctctttccttttaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaa

SEQ ID NO: 2055 - DNA, 4408 bp, Homo sapiens
gggcgcggaggcgaccgccatggcgttcctcaaactccgtgaccagccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaat

SEQ ID NO: 2056 - DNA, 4405 bp, Homo sapiens
ctagtctataccagcaacgactcctacatcgtccactctggggatcttagaaagatccataaagctgcctcccggggacaagtccggaagctggagaagatgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatgagagacaagcagtaagaaacttcttttggagaaacaacagaccagatctttactcacaactcatgctaggaggccagtcctagcatcaccttatgttgaaaatcttaccaatagtctgtgtcaacagaatacttattttagaagaaaaattcatgatttcttcctgaagcctacagacataaaataacagtgtgaagaattacttgttcacgaattgcataaagctgcacaggattcccatctaccctgatgatgcagcagacatcattcaatccaaccag

SEQ ID NO: 2057 - DNA, 1779 bp, Homo sapiens
cctgtccgggggtgggggctaggggagggataacattacatgtatacctatgtaacaaacccgcatgttctgcacatgtaccccagaacttaaagtataatttaaaaaaagaagtatttccagaatctcatataaaaaaagaaaattaaaaatgcagtttatttatgtaaaagatcagtggaacttaaagataatcactgagtgacttacagtaaaaattaaaaaatgaaaaagactagtgtactacaaaagagactatctgaaaaaaaagaaatatcacagaatatcaaaaacttgaatgggaacaagaactctgcagtttgagatttctgatagtcatgaaaaagaagaagacctgttgcataaaaaccatttgatgcaagatgaaattgccaggctcaggctggaaatacacacaataaaaaatcaaatcctggaaaagaaatacttaaaagacattgaaattataaaaagaaagcatgaagaccttcaaaaggctctaaaacagaatggggaaaaatcaacaaaaacgatagcccattatagtggacagcttactgctctgacagatgagaacacaatgctccgttctaaactggagaaggaaaaacaaagcaggcaaagactgacgaaatggaatcataccatcgtagactgaatgttgctctacatgatcatgatcaaagtcactcaacagaaagagaccaagagcttgatttccagggcacagtagataaattgcgtcatttacaggaaaatttgaattctcatgttctgattctttctcagcaactttctaaagctgagagtaagtccaggtgcctcaaaactgagctccataacacaagagaggctctgaaagaaaacgctttggtttttgaacacatacaaagagagctaaaccaaacggtgtcaaatgaaggacattgaaaaaatgtacacaagtggccaagataaagtagaaaaatgcacagaaaagcaagtaagattatgtcaactacgaagacaaaatatgttgcttcaacagcaactggatgatgttcacaacaaagctgacaatcaagaaaaaacagtaattgatagtcaagccaaatgtgatgctacagcacaaaatcttcaagctgagtgcataaagcaccgtcttttgctagaagaacaagaggatgatcaataaagttaatcatttgaaagaaaaacaatgtcaatatgaaagagagaaagcagaaagagaagtagttgtgagacaacttcaacaaaaacagggtgacgtcctaaacaatcaacaacaaaagctttgctggatgcttcattgcgtcactgcgtccattgagaaagtgagatgtaggattcaaggaagaaattaggtcagatgagaattcaatttcaagaaaaatggaatcaacttacagcgactataaaatgtactaaggagacgcaaggccacgtacaaaaacttgaaatagaaaattctagtgttaagaaatacaattaaaaagcaagatggccaaattgagcagcttcagaaaatcctgcgaagttcaagtttgatgcagcagttattgcaagaaaatgaaactacagaaatagatgaagcttcttctgaatttaaatctggatcctctgtagcagaggttcccaacctacaggccatggacaggtccatgacctgttaggaaccagctgcacagcaggagagttactgtggatcttctagatcatctgcatgccatgtgaatcttaaaaccagtttttaatttctacaaaaaaaaaaaaaaaaaa

SEQ ID NO: 2058 - DNA, 2184 bp, Homo sapiens
ggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaagtca

SEQ ID NO: 2059 - DNA, 623 bp, Homo sapiens
cgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggaatgctcacctcagctggtacctgcaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctg

SEQ ID NO: 2060 - DNA, 3073 bp, Homo sapiens
gagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaaga

SEQ ID NO: 2061 - DNA, 5258 bp, Homo sapiens
ggacgcggcgggctcggccacaggtaacccgcaggagccgagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaat

SEQ ID NO: 2062 - DNA, 2968 bp, Homo sapiens
gcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaa

SEQ ID NO: 2063 - DNA, 829 bp, Homo sapiens
aactgtaagtagcgagcttggtttccatgagtcacatgtgtccacagaataggcccaactagacaacagatctgtgggaatgtttggctctccatgaaccacaaagactcctccaacacagaggtgcagtacccacctgggccaaggagggaagatgcaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagaca

SEQ ID NO: 2064 - DNA, 539 bp, Homo sapiens
agttttggtttggccattgacatgtaaatgtcagagaggcctgaggctgttccccagtggaccctcccgccttcccacacaaagccctggctctgtgagggccatggctttgcctttgtgaggcctgggccatcccagctgcagagggaagtccccgtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcac

SEQ ID NO: 2065 - DNA, 3157 bp, Homo sapiens
gaggcagtttattacagatttcaaccctttctgcatccctccctcccttacaacacgcacactcatcttttcttgcattactgctgaaattatgcaaacttcgtttctctgtcatctgagcgtcattcagaaatgttcctccgatctgtgaattgttccctgacttcaatcggggcagtgttacaggtcctctgctggcaggagggagcagtccgtgaaaatctgcagacacaagactttcagaagctgtgacgagcagactagcaagccacaaaacattgcaagctgaatggatgtcttaataagcttttagatgtgatttggccagcatcagcagaggaggctaacgggaaaaggcagcgaacattgtaacgtaaatcactgcagatttgctgggagtgacagccctaggaagctaatgatctctccaggaaagaattgaccacagttatccagaaactgaacacgatgtagaacagagaggacagcccctcggatgtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattc

SEQ ID NO: 2066 - DNA, 576 bp, Homo sapiens
acagttatccagaaactgaacacgatgtagaacagagaggacagcccctcggatgtgagtaccatctcttcaacacaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcat

SEQ ID NO: 2067 - DNA, 546 bp, Homo sapiens
ctcctggctgcttcctgatgtcttgctggcagcaagtgggctagggtcggcttgcccagaggggcgcatccaggtggggttcacctttctgaaccaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggac

SEQ ID NO: 2068 - DNA, 2489 bp, Homo sapiens
catgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaatt

SEQ ID NO: 2069 - DNA, 1298 bp, Homo sapiens
ataacggccggctgcgcgaggcccttccagcatttccactttcgtcaggtactggagagggctgccggccggatgccagggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctac

SEQ ID NO: 2070 - DNA, 1418 bp, Homo sapiens
ataacggccgtaactgccataacggccggctgcgcgaggcccttccagcatttccactttcgtcaggtactggagagggctgccggccggatgccagggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagtgttgtccaatcttctagatggcttttatcctacaccactccgctgaatgactttataagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaacattataaataatcctgtataaatcaaa

SEQ ID NO: 2071 - DNA, 1103 bp, Homo sapiens
gaaaaggatttaaagaaacttcacagagctgcttcagtcggggatttgaagaagctgaaggaataccttcagatcaagaaatatgatgtaaatatgcaggacaaaaaatacagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaagtgaaggaaaacattataaataa

SEQ ID NO: 2072 - DNA, 2063 bp, Homo sapiens
ggcggggcgatctggagtaggaggtgtgaccggagggcgaaattggggcttcctctgctctggtgacccagaaccgtcaactgaaatgaccctgtctgtgtagtactccggcaggatgggcctcggagcgtaaaggcggcaaaaacaaaaatattaaaaaaaaggagagagggacaaaaaaaagaaaacccgaaagtttcagctgcattgctgcggaacgttttttagccagaaggcgaaagaagaaatcggaagtgacgtcgcggccaaaacaagcccgggcttggaggcctgtactgaagctggcctcagatgggaaggcccgactcgctgtctgctgtcgtcggtggtcgcgagaccttgcactctcaccgggtcggcctccagcccctgtgcccgggatccgctcgccgcggatgagcgagagtttcttcctgggacttttcgggcacagctggccggtggcgacagaacggactttctttcctgcaagagtctcccctccagcgggagacagcgggctcctgtctcgggacgctgggacacctgtcgcctatttttaaatatccagattccaagaacacactggatactgctcttacaaaaccaagaggaaatcatgaagaaatgttttagttattgaaactacagttgaaatcatggatacatcaacaaatctggatattggagcccagcttatcgtggaagagtgtcccagcacttatagcctaactggcatgccagacattaaaatagaacatccactggacccaaattcagaagaagggtcagctcagggtgttgccatgggaatgaaattcatattgcctaaccgatttgatatgaatgtgtgttctcgatttgtgaagtccttaaatgaagaagatagtaaaaatattcaagatcaggttaactctgacctggaggtggcatctgtcctatttaaagctgaatgcaatatccatacatctccttctccgggaattcaagtaaggcatgtctacaccccctctacaacaaagcatttctcacccataaaacagtcaaccactttaaccaacaaacacagaggaaatgaggtctctaccacacctctgttagcaaattctttgtctgttcaccagttggctgctcagggagagatgctctatctggctactcgtatcgaacaagaaaatgttatcaatcacacggatgaagaaggatttactcctctgatgtgggctgcagcacacgggcaaatagctgtggtagagttcctacttcagaatggtgctgatccccaacttttaggaaaaggtcgagaaagtgcactgtcgttggcctgtagtaaaggctacacagatattgtcaaaatgctgcttgattgtggagttgatgtaaatgaatatgattggaatggaggaacacctctgctttatgctgtacatggaaatcatgtgaaatgtgtaaagatgctcttagaaagtggggctgatccaacaattgaaactgactctggatataattctatggatctagctgtagccctaggctatagaagtgttcaacaggttattgagtcacatttgttgaagctgcttcaaaatatcaaggagtagacacagtcatcagaaaatgtctgcccttttgtttacttcttggtccttataaatgatagttttgtttacttataaatttttacctcagttgcaatatttactggtttttagtaggttttaataaatatttctctgagtaattcactggtttataataaatgtaatactctttttataactatgttttactgtatatttaaaattataaattaatgttttcgtggcatgtaaatttttatggtacagatagttatcatcagtctttgtatcaagtgctgtaatttgacattttcagaaattattctaccctagtcatcttcactcgtgtattaagtcattcactttatatagggtttgctataaatccctagaaaaaaattgttcttattgttgaataaaaaagtgcacagtgtgattgtttacaaaatgatattataaataaataaaatacttcttctgtca

SEQ ID NO: 2073 - DNA, 1865 bp, Homo sapiens
ggtgcgcatgcgcccggagagctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggagacttatgaccccaatcatgtatgctgctcgagatggtcacacccaggttgttgctctccttgttgctcatggagcagaagttaatacccaggatgagaatggttacactgctttaacgtgggcagcacgtcagggtcataaaaatatagttttgaagttgcttgaacttggagctaataaaatgctacaaaccaaagatggaaagatgccaagtgagattgcaaaaagaaacaaacatcatgagatcttcaacttactttcttttactttaaatccattggaaggaaaacttcaacagctaactaaagaagacactatttgtaaaatattgacaacagattctgatagagaaaaagatcacatttttagttcatatacagcatttggagatctggaagtatttttacatggtcttggacttgaacatatgacagatttactaaaggaaagggatataacgttaagacatcttttgaccatgagggaagatgaatttacaaagaatggaattaccagtaaagaccagcagaaaattctggctgctcttaaagaactacaggtagaagagatacaatttggagagctatctgaagagacaaagttggaaatcagtggtgatgagttcctcaactttcttctcaaattaaataaacagtgtggccatttaataacagctgtacagaatgttattactgagttacctgtaaattctcaaaagataacactggaatgggcttctccccagaattttacttcagtttgtgaagaattggttaataatgttgaagatttgagtgaaaaggtctgcaaactaaaagacctaattcaaaagttgcaaaatgaacgggaaaatgatccaactcatatacaattaagggaagaagtatctacatggaatagtagaattttgaagaggacagctattaccatatgcggattcggttttcttcttttcatttgcaagctaactttccagaggaaataatccaaatatttgttttaagttatatatacacatcttattgaaccatccaaaaatcattgcttttaactgtttgcagcacaatataactttacattctttgccaatattccataggaaaaattttgacaatgtggagtttttttttaaaaagtggtttgttactttgacttataaatacaatttgttatgtttatgttaattgtgattaggtagtaaagtataagtaattttttggtttgatcgtatctaaatcacattcaaaattaaagttatatctaatatctttgacattttttaaagtgtgttcatttgtcagtgaatcgtacaggatttgtaaagtgttcataaattgagctttcttttgtttctttttt

SEQ ID NO: 2074 - DNA, 1509 bp, Homo sapiens
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaa

SEQ ID NO: 2075 - DNA, 2209 bp, Homo sapiens
aaaaaaaaaaaaaaaaaaaaaagcaatcattaagcttttcatctagccattacttttgtacaggctctcattaattccacatagatggtctaatggtctactaaatagtattctaatcctccatcttgtctatctcttagccattctccatgataaaggatgaatggtctttcggaaacataaatgaaaccatgctgctttaaaaaaacaaacaaacaaaaagaaacccattaatgttttcccaaagctttgtggacacattgaagcttcttgtttcagcttctgccaacatttctcgctccagcaaactttcttctgcttcccaaatatgacaagcttcttctttaacttttctgccaggttaatcttgactcatttcaagagaggcttgggtcagccagggcctactctaagaagtttctttagcccttatgttttcctatggagagcacacactagctttaagtcctgagggtacttaagatgatatttcaatgtttttgtactcttagtgcttggcatatggtgggtggtctacaaatttagaacaatgtagtgaaccacaaactcctctcttcagcctgtgtgcttacttgtagtagttgtctgatctctaaaatttagaactgaatatgccaagaaagagttcaatttcagagaggagggtatggtttcattttaagtataaaagcttcctttaaaaaaaattacgtcttacattttgttatgctcctaagtgtaattgatcctggaaagtaagcgcaaggctactctctaatgctaactcttatgtatgtaagaggtgaggaaggagaggttgtgtgtggtgcatttgttttgtaaaagcatctaactgttttctttccagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaa

SEQ ID NO: 2076 - DNA, 526 bp, Homo sapiens
tttgcaagaaggtagagataaagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccag

SEQ ID NO: 2077 - DNA, 799 bp, Homo sapiens
agtgtgaaatcttcagagaagaatttctctttagttctttgcaagaaggtagagataaagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtg

SEQ ID NO: 2078 - DNA, 1417 bp, Homo sapiens
acagtatctcaagtcatgctgtatccagatttgcttttacattttcttgcctgagtctgaggtgaacagtgaacatatttacatttgatttaacagtgaaccttaattctttctggcttcacagtgaaacaagtttatgcaatcgatcaaatattttcatccctgaggttaacaattaccatcaaaatgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatatgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcaggacacttcagagatactctcatgaacttggtccaggggaccagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaatatttctgggcaagatatggtagatgccattaatgaatgttatgatggatactttcaggagctgctggttgcaattgttctctgtgttcgagacaaaccagcctattttgcttatagattatatagtgcaattcatgactttggtttccataataaaactgtaatcaggattctcattgccagaagtgaaatagacctgctgaccataaggaaacgatacaaagagcgatatggaaaatccctatttcatgatatcagaaattttgcttcagggcattataagaaagcactgcttgccatctgtgctggtgatgctgaggactactaaaatgaagaggacttggagtactgtgcactcctctttctagacacttccaaatagagattttctcacaaatttgtactgttcatggcactattaacaaaactatacaatcatattttctcttctatctttgaaattattctaagccaaagaaaactatgaatgaaagtatatgatactgaatttgcctactatcctgaatttgcctactatctaatcagcaattaaataaattgtgcatgatggaataatagaaaaa

SEQ ID NO: 2079 - DNA, 1283 bp, Homo sapiens
atgttttgtagtaatttagtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatatgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcaggacacttcagagatactctcatgaacttggtccaggggaccagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaatatttctgggcaagatatggtagatgccattaatgaatgttatgatggatactttcaggagctgctggttgcaattgttctctgtgttcgagacaaaccagcctattttgcttatagattatatagtgcaattcatgactttggtttccataataaaactgtaatcaggattctcattgccagaagtgaaatagacctgctgaccataaggaaacgatacaaagagcgatatggaaaatccctatttcatgatatcagaaattttgcttcagggcattataagaaagcactgcttgccatctgtgctggtgatgctgaggactactaaaatgaagaggacttggagtactgtgcactcctctttctagacacttccaaatagagattttctcacaaatttgtactgttcatggcactattaacaaaactatacaatcatattttctcttctatctttgaaattattctaagccaaagaaaactatgaatgaaagtatatgatactgaatttgcctactatcctgaatttgcctactatctaatcagcaattaaataaattgtgcatgatggaataatagaaaaattgcattggaatagattttatttaaatgtgaaccatcaacaacctacaacaa

SEQ ID NO: 2080 - DNA, 2534 bp, Homo sapiens
gcactgcctctggcacctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccaggtgagggctctcaggcagagcctgaatgtgctttcgtcttctcttccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtc

SEQ ID NO: 2081 - DNA, 2729 bp, Homo sapiens
gcactgcctctggcacctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccagggattattggacctgcctggtttaaactattgtcttagttaattttgtgctgctctaacaaaatatcacagactgagtaatttataagcaatagtagcttatttggctcacagttctggaggctgagaagatcgtgaggctgcatctggcaagggccttcttgctgcttcataacatggcagaagacatcatgcggcaggggctctcaggcagagcctgaatgtgctttcgtcttctcttccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtc

SEQ ID NO: 2082 - DNA, 1780 bp, Homo sapiens
gacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgagtatctcctgcatgccagcaagctatggacatctggaagaagccacatgccttgccctcaagttgcttagggtggaaggaaatgattag

SEQ ID NO: 2083 - DNA, 6720 bp, Homo sapiens
gcactgcctctggcacctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgtaatcccagctacacaggatgctgaggcaggagaatcacttgaacccaggaggcagaggttgtagtgagctgagatcacaccattgcacttcaacctgggtggacagagtgagactctgtctcaaaaaaaaaaaaaaatttacctggcattgtagtgcattccctatagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccgaagggtgtggagcagccatgagctgagaactagcctggtctacctgagattgatggcaggtcctggtcaacacgtcagctctgcgtcagagtccatgcctcaagcccaagctgaagccccatccctgctgctctcccaagaactcctctgctagggcaggccccttgcccttgggtgccaggtgggacctgcctgatgggatggggtgcttggcatatacaacttgccatgaactcaaggtgaccctgggggcctcctgaattgtgatggggcctagaaccaatgtgctctgatgtgaccatattctgtgacattaccttgccctgtttactccaaagttcccagcctggtgcccagcaggcaatattgcacctacagacacatttactttggtttccaaagtgtttttagacatttgaatttgttgccaacatttaaacattgagagatttcatatttttaaaaatctggaattctggcttctcttgaaaactcagaaattctggcactatggggcttgcattcctgcatggctggagctgagttgcagctgcccctttaggcctgtactccttatttgctataggctccgtcttgtattacactaagcccatgtcacccatttggctcctgcaggcctttgggtttgagaccctggtctacacacttggagaccacctgttgtaaagtacatggatgtgctttggtcaaggaatagaccaaggtggatatccaggccagagtgactcagcgagtttaggtcacaggcgtatactccacttgttatataacctgcttgtgtaagttcatacttggctcaaagccactattgtttggaaaaggtataactgccctgctgacgctgtacagatgttcttgggctcggatgggcatggctccacgtggtgtgcactagcacccagagagagtgaagctattgacccctgtaagggagagtgaccatctggcagatagatagaggggagccaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatagggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagtgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaaga

SEQ ID NO: 2084 - DNA, 6699 bp, Homo sapiens
ttcctggagcagctccgcagccggaaggctgctgctcctcgcgggcccgccgtgcccacccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgtaatcccagctacacaggatgctgaggcaggagaatcacttgaacccaggaggcagaggttgtagtgagctgagatcacaccattgcacttcaacctgggtggacagagtgagactctgtctcaaaaaaaaaaaaaaatttacctggcattgtagtgcattccctatagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccgaagggtgtggagcagccatgagctgagaactagcctggtctacctgagattgatggcaggtcctggtcaacacgtcagctctgcgtcagagtccatgcctcaagcccaagctgaagccccatccctgctgctctcccaagaactcctctgctagggcaggccccttgcccttgggtgccaggtgggacctgcctgatgggatggggtgcttggcatatacaacttgccatgaactcaaggtgaccctgggggcctcctgaattgtgatggggcctagaaccaatgtgctctgatgtgaccatattctgtgacattaccttgccctgtttactccaaagttcccagcctggtgcccagcaggcaatattgcacctacagacacatttactttggtttccaaagtgtttttagacatttgaatttgttgccaacatttaaacattgagagatttcatatttttaaaaatctggaattctggcttctcttgaaaactcagaaattctggcactatggggcttgcattcctgcatggctggagctgagttgcagctgcccctttaggcctgtactccttatttgctataggctccgtcttgtattacactaagcccatgtcacccatttggctcctgcaggcctttgggtttgagaccctggtctacacacttggagaccacctgttgtaaagtacatggatgtgctttggtcaaggaatagaccaaggtggatatccaggccagagtgactcagcgagtttaggtcacaggcgtatactccacttgttatataacctgcttgtgtaagttcatacttggctcaaagccactattgtttggaaaaggtataactgccctgctgacgctgtacagatgttcttgggctcggatgggcatggctccacgtggtgtgcactagcacccagagagagtgaagctattgacccctgtaagggagagtgaccatctggcagatagatagaggggagccaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatagggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagtgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaaga

SEQ ID NO: 2085 - DNA, 6769 bp, Homo sapiens
gcactgcctctggcacctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgtaatcccagctacacaggatgctgaggcaggagaatcacttgaacccaggaggcagaggttgtagtgagctgagatcacaccattgcacttcaacctgggtggacagagtgagactctgtctcaaaaaaaaaaaaaaatttacctggcattgtagtgcattccctatagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccgaagggtgtggagcagccatgagctgagaactagcctggtctacctgagattgatggcaggtcctggtcaacacgtcagctctgcgtcagagtccatgcctcaagcccaagctgaagccccatccctgctgctctcccaagaactcctctgctagggcaggccccttgcccttgggtgccaggtgggacctgcctgatgggatggggtgcttggcatatacaacttgccatgaactcaaggtgaccctgggggcctcctgaattgtgatggggcctagaaccaatgtgctctgatgtgaccatattctgtgacattaccttgccctgtttactccaaagttcccagcctggtgcccagcaggcaatattgcacctacagacacatttactttggtttccaaagtgtttttagacatttgaatttgttgccaacatttaaacattgagagatttcatatttttaaaaatctggaattctggcttctcttgaaaactcagaaattctggcactatggggcttgcattcctgcatggctggagctgagttgcagctgcccctttaggcctgtactccttatttgctataggctccgtcttgtattacactaagcccatgtcacccatttggctcctgcaggcctttgggtttgagaccctggtctacacacttggagaccacctgttgtaaagtacatggatgtgctttggtcaaggaatagaccaaggtggatatccaggccagagtgactcagcgagtttaggtcacaggcgtatactccacttgttatataacctgcttgtgtaagttcatacttggctcaaagccactattgtttggaaaaggtataactgccctgctgacgctgtacagatgttcttgggctcggatgggcatggctccacgtggtgtgcactagcacccagagagagtgaagctattgacccctgtaagggagagtgaccatctggcagatagatagaggggagccaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatagggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagtgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaaga

SEQ ID NO: 2086 - DNA, 1859 bp, Homo sapiens
gacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatgctggcggctttgggcagcccccctctgcccagcagcctgttcctccctatgggatgtatccacccccaggaggaaacccaccctccaggatgccctcatatccgccataccctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctg

SEQ ID NO: 2087 - DNA, 610 bp, Homo sapiens
agtgaactggtctgcgacaagcagggcagatgcagcagtttcttctgcagggtcccagttgtggtggtggctgccctttcaagaagctgggtcccacgggccagcaggggctctcaggcagagcctgaatgtgctttcgtcttctcttccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtg

SEQ ID NO: 2088 - DNA, 6965 bp, Homo sapiens
gcactgcctctggcacctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccagggattattggacctgcctggtttaaactattgtcttagttaattttgtgctgctctaacaaaatatcacagactgagtaatttataagcaatagtagcttatttggctcacagttctggaggctgagaagatcgtgaggctgcatctggcaagggccttcttgctgcttcataacatggcagaagacatcatgcgggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgtaatcccagctacacaggatgctgaggcaggagaatcacttgaacccaggaggcagaggttgtagtgagctgagatcacaccattgcacttcaacctgggtggacagagtgagactctgtctcaaaaaaaaaaaaaaatttacctggcattgtagtgcattccctatagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccgaagggtgtggagcagccatgagctgagaactagcctggtctacctgagattgatggcaggtcctggtcaacacgtcagctctgcgtcagagtccatgcctcaagcccaagctgaagccccatccctgctgctctcccaagaactcctctgctagggcaggccccttgcccttgggtgccaggtgggacctgcctgatgggatggggtgcttggcatatacaacttgccatgaactcaaggtgaccctgggggcctcctgaattgtgatggggcctagaaccaatgtgctctgatgtgaccatattctgtgacattaccttgccctgtttactccaaagttcccagcctggtgcccagcaggcaatattgcacctacagacacatttactttggtttccaaagtgtttttagacatttgaatttgttgccaacatttaaacattgagagatttcatatttttaaaaatctggaattctggcttctcttgaaaactcagaaattctggcactatggggcttgcattcctgcatggctggagctgagttgcagctgcccctttaggcctgtactccttatttgctataggctccgtcttgtattacactaagcccatgtcacccatttggctcctgcaggcctttgggtttgagaccctggtctacacacttggagaccacctgttgtaaagtacatggatgtgctttggtcaaggaatagaccaaggtggatatccaggccagagtgactcagcgagtttaggtcacaggcgtatactccacttgttatataacctgcttgtgtaagttcatacttggctcaaagccactattgtttggaaaaggtataactgccctgctgacgctgtacagatgttcttgggctcggatgggcatggctccacgtggtgtgcactagcacccagagagagtgaagctattgacccctgtaagggagagtgaccatctggcagatagatagaggggagccaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatagggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagtgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaaga

SEQ ID NO: 2089 - DNA, 1051 bp, Homo sapiens
cgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaaggaacgatgattccataccttaccaggtccccttgcctgatgaaccagaggttggagaatgaagagagacaggggcctctgacttcccctgttgctggagggatggcaataaggacacaggaagataaatagacagacctggagtcctgagaatgaggcagtgcgtctctacctctgagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcga

SEQ ID NO: 2090 - DNA, 750 bp, Homo sapiens
gggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgagtatctcctgcatgccagcaagctatggacatctggaagaagccacatgccttgccctcaagttgcttagggtggaaggaaatgattagaaatgagccaagccgagcctgcactcttagaggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatcc

SEQ ID NO: 2091 - DNA, 2602 bp, Homo sapiens
ctctgttctctgcgctgggcatggagtggagctgtgaggccgagcccctgccctgccctgccctgccctgcccacgcaacagggactaggtttgcagggcagggcctggtatgctcacccttcactggctctcattgctttcctcattccttttatgcggcagtcaattgttggggattccaggggattaacagggcccctttcctcaaggcattctttgtgctgcaaggtgttccctgataagagaggccagggtttcacttccatcgcccaggctggagtgcaatggcgtgatctgggctcactgcaacctccacctcccaggctcaaatgattctcctgcctcagcctcctgagtagagtagctgggaccacagtcgcatgccatggtgctcggctaatttttttgtattttatttttgtaacgacagggtctcattatgttgcccaggctggtgtcaaacttctgagctcaaatgatctgcctgcgtcagcctcccaaagtgctgggattataggcatgggccactgtgcctggcctcatcttgtcattttaaagaatatatcagcagggattattggacctgcctggtttaaactattgtcttagttaattttgtgctgctctaacaaaatatcacagactgagtaatttataagcaatagtagcttatttggctcacagttctggaggctgagaagatcgtgaggctgcatctggcaagggccttcttgctgcttcataacatggcagaagacatcatgcgggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactc

SEQ ID NO: 2092 - DNA, 2155 bp, Homo sapiens
acctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggttggctggcactggcctgggttctctctctatagtagaaatcctgccatccagatcctgccactgccacctttgctagcacagctgagcagcctctgagcagcaagagaggaggaggcaggaaatttagggaaggttcttcctggagggtctggagccctggagatgaagagccgatccgaagctgccatgtagaggaaagcatctaacaggccagaggccccatgatgatgtcgaatgcccatcgggcacccagctgagccctgcaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatag

SEQ ID NO: 2093 - DNA, 1444 bp, Homo sapiens
ctcagcatttggggacgctctcagctctcggcgcacggcccaggtaagcggggcgcgccctgcccgcccgcgatgggccgccagctagcggggtgtggagacgctgggaagaaggcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaa

SEQ ID NO: 2094 - DNA, 1676 bp, Homo sapiens
gctcagcatttggggacgctctcagctctcggcgcacggcccagggtgaaaatgtttgccattaaactcacatgaagtaggaaatatttatatggatacaaaaggcacctgcatgggataatgtcaaatttcatagatactgctttgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcagttcctgagtcacacaa

SEQ ID NO: 2095 - DNA, 1444 bp, Homo sapiens
gctcagcatttggggacgctctcagctctcggcgcacggcccaggttatcttgtagcatagcaacttcggatttcactctacccggagagtttcccgcttggttgaacacattggcctcaggaagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgt

SEQ ID NO: 2096 - DNA, 1435 bp, Homo sapiens
gcctcgcctagggaggatgtggcgggtataaaagccccacccaggccagccggctctgctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgt

SEQ ID NO: 2097 - DNA, 369 bp, Homo sapiens
attccagcaggaaaacaggatggaggaaggtacaaagcatgaatgagcctggcctgtccagcagtggcacatggagcggtgaagagtgaagatgtgggggaatgaggctgcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaag

SEQ ID NO: 2098 - DNA, 812 bp, Homo sapiens
gctcagcatttggggacgctctcagctctcggcgcacggcccaggttatcttgtagcatagcaacttcggatttcactctacccggagagtttcccgcttggttgaacacattggcctcaggaagagacgctcttctggctcttccgtgacgcattacaacagccatccaggccggtccagttacgctgcattccttcctccttcccatttcggcggacctgcatccagctagagactagcagattgaatcgatattcattaagttaggaatgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaag

SEQ ID NO: 2099 - DNA, 557 bp, Homo sapiens
ctgctcagcatttggggacgctctcagctctcggcgcacggcccaggttatcttgtagcatagcaacttcggatttcactctacccggagagtttcccgcttggttgaacacattggcctcaggaagagacgctcttctggctcttccgtgacgcattacaacagccatccaggccggtccagttacgctgcattccttcctccttcccatttcggcggacctgcatccagctagagactagcagattgaatcgatattcattaagttaggaatggttggtggtcctaagagcctcagcaaccgagaggagtcttgttatttaaaaaacaacgatactgggcgtggtcgtgggcctgtagtcccagctgctcaagctagtggatctcttgagtccaaggccaatcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaaga

SEQ ID NO: 2100 - DNA, 513 bp, Homo sapiens
gctcagcatttggggacgctctcagctctcggcgcacggcccagagacgctcttctggctcttccgtgacgcattacaacagccatccaggccggtccacttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctcca

SEQ ID NO: 2101 - DNA, 560 bp, Homo sapiens
actctcagtgtgtcacagaggcacgaagggaagagagctcaaagggtgaaaatgtttgccattaaactcacatgaagtaggaaatatttatatggatacaaaaggcacctgcatgggataatgtcaaatttcatagatactgctttgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgct

SEQ ID NO: 2102 - DNA, 669 bp, Homo sapiens
gaagggaagagagctcaaaggtcctgcagggtggaagtctgcatttcacagttttataagtgtcttttgtatcctttaatatagtgcaggctcagcgtatgcttgggtgaaaatgtttgccattaaactcacatgaagtaggaaatatttatatggatacaaaaggcacctgcatgggataatgtcaaatttcatagatactgctttgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaa

SEQ ID NO: 2103 - DNA, 521 bp, Homo sapiens
gctcagcatttggggacgctctcagctctcggcgcacggcccagagacgctcttctggctcttccgtgacgcattacaacagccatccaggccggtccagttacgctgcattccttcctccttcccatttcggcggacctgcatccagctagagactagcagattgaatcgatattcattaagttaggaatgatggagcctggctctgtcacccagcctggagtgtagtcgcacgatctctcctcactgtagcctccgcctcccaggttcaagtgattctccagcctcaccctcccgagtagctgggattacagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatg

SEQ ID NO: 2104 - DNA, 755 bp, Homo sapiens
tttggggacgctctcagctctcggcgcacggcccaggttatcttgtagcatagcaacttcggatttcactctacccggagagtttcccgcttggttgaacacattggcctcaggaagagacgctcttctggctcttccgtgacgcattacaacagccatccaggccggtccagttacgctgcattccttcctccttcccatttcggcggacctgcatccagctagagactagcagattgaatcgatattcattaagttaggaatgatggagcctggctctgtcacccagcctggagtgtagtcgcacgatctctcctcactgtagcctccgcctcccaggttcaagtgattctccagcctcaccctcccgagtagctgggattacagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaag

SEQ ID NO: 2105 - DNA, 878 bp, Homo sapiens
actgcctgctacgaggccgcgcagagatgccccaggcgcggagagaagcggagcacagccgtgctagggacaggggcgccaccctgggcgggactgagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcc

SEQ ID NO: 2106 - DNA, 558 bp, Homo sapiens
tcagcatttggggacgctctcagctctcggcgcacggcccagagacgctcttctggctcttccgtgacgcattacaacagccatccaggccggtccagttacgctgcattccttcctccttcccatttcggcggacctgcatccagctagagactagcagattgaatcgatattcattaagttaggaatgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaag

SEQ ID NO: 2107 - DNA, 718 bp, Homo sapiens
ctctcagctctcggcgcacggcccaggtaagcggggcgcgccctgcccgcccgcgatgggccgccagctagcggggtgtggagacgctgggaagaagggttatcttgtagcatagcaacttcggatttcactctacccggagagtttcccgcttggttgaacacattggcctcaggaagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaag

SEQ ID NO: 2108 - DNA, 779 bp, Homo sapiens
aggttatcttgtagcatagcaacttcggatttcactctacccggagagtttcccgcttggttgaacacattggcctcaggaaggtacttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaag

SEQ ID NO: 2109 - DNA, 594 bp, Homo sapiens
atggctgtgatctttctctctgtgtcttaatcacttggaataaagaaccattgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaag

SEQ ID NO: 2110 - DNA, 663 bp, Homo sapiens
gctcagcatttggggacgctctcagctctcggcgcacggcccagagacgctcttctggctcttccgtgacgcattacaacagccatccaggccggtccagttacgctgcattccttcctccttcccatttcggcggacctgcatccagctagagactagcagattgaatcgatattcattaagttaggaatggttggtggtcctaagagcctcagcaaccgagaggagtcttgttatttaaaaaacaacgatactgggcgtggtcgtgggcctgtagtcccagctgctcaagctagtggatctcttgagtccaaggccaatcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacg

SEQ ID NO: 2111 - DNA, 1657 bp, Homo sapiens
attgcagtacatttgagaaagtaaaggtgtagtggaaaccgagagcgaaatgagggcgtagggagaaaagggtggggaagcttagagaccggtgagggagcagagctggggcgcctgtgtacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaagcaagat

SEQ ID NO: 2112 - DNA, 567 bp, Homo sapiens
cctcctcaaagagcagatgtgtctttataacagactgtaggcttggagccttgtaaaatgtacatggagtttcacaatcaagcacaaggaatccaactgaaggcagctaaactttgtgttgatttgattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacag

SEQ ID NO: 2113 - DNA, 545 bp, Homo sapiens
actcgcacaccagtttcccccaccgcgctttggctagcagcgtaagggatccacttagccatctcggcctccccagtcctaaaggtctaggggacagaaaaaagctgggagtcggaaggttcctcgggtccccggcatggcagacggggctggctcagaggtctgctctgtggacttggaatcgcacccatcctattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagg

SEQ ID NO: 2114 - DNA, 880 bp, Homo sapiens
ctcgaccctgggcagggctggcggctggcgcccgcgcccggccccaacccagctgcgtgggtggggagctggagggacctcagtcctgcatttcagagtcgaggagactgggcccacgggggggaaagtgccgtgccatgggtgggtcacccaggtcttggtggggcccaagctgatactcagctgtcctcgctccctgaaagcttcgcttattacagctagcagcgtaagggatccacttagccatctcggcctccccagtcctaaaggtctaggggacagaaaaaagctgggagtcggaaggttcctcgggtccccggcatggcagacggggctggctcagaggtctgctctgtggacttggaatcgcacccatcctattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaag

SEQ ID NO: 2115 - DNA, 2163 bp, Homo sapiens
gcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaagaa

SEQ ID NO: 2116 - DNA, 1414 bp, Homo sapiens
gcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaa

SEQ ID NO: 2117 - DNA, 1703 bp, Homo sapiens
taagacccgctgtctggccctgagtagggtgtgacctccgcagccgcagaggaggagcgcagcccggcctcgaagaacttctgcttgggtggctgaactctgatcttgacctagagtcatggccatgcacaaacaacgaggaaacagaagattcaccaaacatttatgaacagccagctgttataaagacaagggaccaatctgaaaaatcagaataaagtctccttgttaaagctgctgcaagaaacaggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttga

SEQ ID NO: 2118 - DNA, 1762 bp, Homo sapiens
aggcgcgctgaggccggggcaggggcgggcccggctggcgcggccggcctgcggttggggccctggcgggggtgggacgggccaagccgggcagggccggggtggggccgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttattt

SEQ ID NO: 2119 - DNA, 2593 bp, Homo sapiens
agaggggtggggtggaggagggaggcgggcgcgccggattggcctctgcgcgccacgtgtccggctcggagcccacggctgtcctcccggtccgccccgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaa

SEQ ID NO: 2120 - DNA, 2441 bp, Homo sapiens
gatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgt

SEQ ID NO: 2121 - DNA, 923 bp, Homo sapiens
ggacttgttatgatcgagggctgctaggcagagatgttggctgcttcctgggccctggcaagtcactttctctttctgagatgcctttaccccgtctagaaaatgagggacttggagtcatggattattaagggcccttgtgggattcagaaacactagatgtaaaatattcagccaatttgagcagtatggtctaggttgctctgggagggatcagaagccatcttaaagccagggtaaatggtgtgtttatgattagctcaggagcttcccagaaccctcagaggcggggctgtggaatcagcagggggactggccctcagaactgcagtctgaacatctagttctggaaggagcttgctttttacatatgaactgtgcactcacacaaggcacacagaaactgctctcagagctgagaatattttcccaaacagtaagaggcccctccttgaagccatctctccttggaaaggggagctcctccagatgggcctgggctgcagccagcagctgaaattgccagcaacaagcccagaggaaagtgcttcaaggctggagatgcagtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactg

SEQ ID NO: 2122 - DNA, 2451 bp, Homo sapiens
tccagaggcctggccggggtcctgcagtgcagacgttgggaggcacggagacggggagagggggaggcggtccaggactcactctgctccacctctgactccttgaagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgt

SEQ ID NO: 2123 - DNA, 2013 bp, Homo sapiens
aacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggt

SEQ ID NO: 2124 - DNA, 2174 bp, Homo sapiens
cccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagatcaatacagattctttttcttcctatcctgttttctctcctgtttctttggattatagcagtgaacctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtgtgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 2125 - DNA, 2108 bp, Homo sapiens
cccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtgtgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 2126 - DNA, 648 bp, Homo sapiens
tcagatttttttttcctttattttgaccctgacccttttgcccttggtctatctacttttctttttctttctttttttttttctttttccttgtcttgtcttgtcttttctttcaactggagtgcaatgatgcaaacacgactcactgccgccttgacctcctggcctcaagcaattctcccacctcagcttcctgaatagtttggactacagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtca

SEQ ID NO: 2127 - DNA, 1250 bp, Homo sapiens
atcttgcgggagaccgggttgggctgtgacgctgctgctggggtcagcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggaggga

SEQ ID NO: 2128 - DNA, 1954 bp, Homo sapiens
cccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 2129 - DNA, 1861 bp, Homo sapiens
cgggggcgaggggacggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaa

SEQ ID NO: 2130 - DNA, 1179 bp, Homo sapiens
agacgtgtggagtcccagcagaggccaacctgtgtctcttcatctccctgggaaaggtgcccccgaggtgaaagagatggcctggtggaaatcctgggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgc

SEQ ID NO: 2131 - DNA, 1171 bp, Homo sapiens
aggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggtcatttcccagtgtgagcacaatgccaaccttagtgtttctccagccagacagatgcctcagcatgaagggcttggggacttgtggatcattccttcctccctgca

SEQ ID NO: 2132 - DNA, 1826 bp, Homo sapiens
ggtcccacctggacccacagggaaggcagtgcataaaagcctcctgtgtttgaggctgagccgctgagaggctgagtggagttcactcacatggattgaggcccagttcctgggagaagagatgctgggcaggaaggtgtctgcatgtgggactctgtacagcccggtcctctcccacgtctgggaggggccagagtcagacaactgctgggttcgtccctaagagaggtcatctgactggctgttcagcctaggctgcacacacccccactttcctctaccaggccacaccggaggcagtgctcacacaggcaagctaccaggccacaacaacgacacccacctcacctctggcacctctgagcatccacgtacttgcaagaactcttgctcacatcagctaagagattgcacctgctgacctagagattccggcctgtgctcctgtgctgctgagcagggcaaccagtagcaccatgtctgtgactggcgggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcaaaggcagctcatctcacgaaacttccaggagcgcacccaacaggacctgatgaagtctctacaggcagcactttccggcaacctggagaggattgtgatggctctgctgcagcccacagcccagtttgacgcccaggaattgaggacagctctgaaggcctcagattctgctgtggacgtggccattgaaattcttgccactcgaaccccaccccagctgcaggagtgcctggcagtctacaaacacaatttccaggtggaggctgtggatgacatcacatctgagaccagtggcatcttgcaggacctgctgttggccctggccaaggggggccgtgacagctactctggaatcattgactataatctggcagaacaagatgtccaggcactgcagcgggcagaaggacctagcagagaggaaacatgggtcccagtcttcacccagcgaaatcctgaacacctcatccgagtgtttgatcagtaccagcggagcactgggcaagagctggaggaggctgtccagaaccgtttccatggagatgctcaggtggctctgctcggcctagcttcggtgatcaagaacacaccgctgtactttgctgacaaacttcatcaagccctccaggaaactgagcccaattaccaagtcctgattcgcatccttatctctcgatgtgagactgaccttctgagtatcagagctgagttcaggaagaaatttgggaagtccctctactcttctctccaggatgcagtgaaaggggattgccagtcagccctcctggccttgtgcagggctgaagacatgtgagacttccctgccccaccccacatgacatccgaggatctgagatttccgtgtttggctgaacctgggagaccagctgggcctccaagtaggataacccctcactgagcaccacattctctagcttcttgttgaggctggaactgtttctttaaaatcccttaattttcccatctcaaaattatatctgtacctgggtcatccagctccttcttgggtgtggggaaatgagttttctttgatagtttctgcctcactcatccctcctgtaccctggccagaacatctcactgatactcgaattcttttggcaaa

SEQ ID NO: 2133 - DNA, 2118 bp, Homo sapiens
acgcacactgagtccaggtcctcctgaaggtcaccagcacagcggggccctgtgttactgtagagagaagtcagttgcttagtttcagcctcctgccggcaccagatgctgaccaggccctcccaggtgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagaggtaaccgaaattttattcatctctggcagccccttctgtcttgcttacgatttgtctacaccatgcacttgggagaagcagctgcagcacatttgttcagcaaagagcagcaggtttctttccttcttgctggaaacttttctgttcccctgatgtggtggggtgggctttaatcttatctggtgtgttcatatagaatcacctagaaggataaagtcgctgtagagttaatgaaag

SEQ ID NO: 2134 - DNA, 4790 bp, Homo sapiens
aaaggcgggccggctggcgtccaagttcctgaccaggcgcgggccggcccgcgggaccagcagccgggtggcggcgcgatcggccccgagaggctcaggcgccccccgcatcgagcgcgcgggccgggcgggccagggcggcgggcggagcgggaggcggccacgtccccggcgggcctgggcgcggggaggcccggccccctgcgagcgcgccgcgaacgctgcggtctccgcccgcagaggccgccggggccgtggatggggagggcgcgccgcccggcggtcccagcgcacaggcggccacgatgagggtcaacgagaagtactcgacgctcccggccgaggaccgcagcgtccacatcatcaacatctgcgccatcgaggacatcggctacctgccgtccgagggcacgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagaagcgccggcatattccagaggagtcaacaaacaaatggaagcagagggttaagacagccatggcgggggtgaaattgactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccgtagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacga

SEQ ID NO: 2135 - DNA, 4443 bp, Homo sapiens
ggatggggagggcgcgccgcccggcggtcccagcgcacaggcggccacgatgagggtcaacgagaagtactcgacgctcccggccgaggaccgcagcgtccacatcatcaacatctgcgccatcgaggacatcggctacctgccgtccgagggcacgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccgtagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacg

SEQ ID NO: 2136 - DNA, 3289 bp, Homo sapiens
tgagtccaggtcctcctgaaggtcaccagcacagcggggccctgtgttactgtagagagaagtcagttgcttagtttcagcctcctgccggcaccagatgctgaccaggccctcccaggtggtgagcaatgctgtttccaggagaggcatcctagggccagagaggccaaggtgccagggacatggccccaactgtcccctaaccaggggtagaggagtctagacccttgacatcaacacctatgaaagctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctca

SEQ ID NO: 2137 - DNA, 4533 bp, Homo sapiens
ggatggggagggcgcgccgcccggcggtcccagcgcacaggcggccacgatgagggtcaacgagaagtactcgacgctcccggccgaggaccgcagcgtccacatcatcaacatctgcgccatcgaggacatcggctacctgccgtccgagggcacgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagagaaagcacttctggatcatcctagagctgaatacgaagccagagtcttggagaagtctctgaagaaagagtccagaaacaaagagaagcgccggcatattccagaggagtcaacaaacaaatggaagcagagggttaagacagccatggcgggggtgaaattgactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccgtagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacg

SEQ ID NO: 2138 - DNA, 2465 bp, Homo sapiens
atgctggatgcagcatccaaagccagagaagccccagaggcagctcccgggtgggatgatccccagggggagggccgcaggggcagaggcgagggactgtcctgggcagtgggtccccacccggatccaggagtcctgatgcaaggggaagtttggtctggaagattcagccatgcagtcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccgtagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacg

SEQ ID NO: 2139 - DNA, 4455 bp, Homo sapiens
ggatggggagggcgcgccgcccggcggtcccagcgcacaggcggccacgatgagggtcaacgagaagtactcgacgctcccggccgaggaccgcagcgtccacatcatcaacatctgcgccatcgaggacatcggctacctgccgtccgagggcacgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagagaaagcacttctggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccgtagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacg

SEQ ID NO: 2140 - DNA, 3212 bp, Homo sapiens
gaccgcatctaggccccgccgcgtccgccacgcccagcgctcggcggcgcccgccccactggcctggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaggcaacctctctgactccttctgcctacataggtaccgcaatgggcttcccttttctgaagcacttggtgaggtcactgaaggtggagcggtgagatcaggagcccagggtgaggggcttggctggaggccaggcaccaaagcttgtagctgaaggctgggccatttttgagaactgctgctggtggtgcccacctacagggacactagggctgctttcacatgcagggtgtacccatggtgccaagccaagggccagcagccactcctggtgccctggcctgggcttgggcttgcagagaaaagggccctccttgcccagtggtgctgcccacctccctagctgtgtccatggactgccctgcattcacaggcacaagaatgccatgtaggccagtgctgcccacgtatacagcccttcccaccagcgctggccgtcctgctgtagccaagacactacagacccgtgggcacctccactcggacagcagcagatgccctggccc

SEQ ID NO: 2141 - DNA, 2039 bp, Homo sapiens
ccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaggcaa

SEQ ID NO: 2142 - DNA, 511 bp, Homo sapiens
atcccctccaaggaagcgccgccccttcctacggctacgggaaggatcgtccagtggctgaggctggacagagcacagatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaa

SEQ ID NO: 2143 - DNA, 641 bp, Homo sapiens
gcgtccgccatccccagccagcatgcactagttctcccgcccgacgctcccgggtgtaagcgcggggcgggacagtcagcccagagggactggcgagactcacccgaatgagttaggtgttttagctaatttgaataatgactgtattcatgcatcaccccgtcggtgttggctgtcaggtggcaccttggggacggagtagagatggggtttcaccatgttggccaggatggtctcaatcttctgacctcatgatccgcccacctcggcctcccaaggtgctgggattacagatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatg

SEQ ID NO: 2144 - DNA, 497 bp, Homo sapiens
ggctttgcgtccgccatccccagccagcatgcactagttctcccgcccgacgctcccgggtgtaagcgcggggcgggacagtcagcccagagggactggcgagactcacccgaatgagttaggtgttttagctaatttgaataatgactgtattcatgcatcaccccgtcggtgttggctgtcaggtggcaccttggggacggaggtgcgtccggtcctggaagagcctagctagtgtccgatagatggtgcagtggcaaatgaaatggcgtaatcgagagatggggtttcaccatgttggccaggatggtctcaatcttctgacctcatgatccgcccacctcggcctcccaaggtgctgggattacagatttgtcaaagatgaaagtgaccttatcagctttggatacttctgagagttctttcacacctttggtggtcatagaacttgctcaggatgtcaaagaagaaaccaaagaatggctgaaaaacagaat

SEQ ID NO: 2145 - DNA, 560 bp, Homo sapiens
ttcctacggctacgggaaggatcgtccagtggctgaggctggacagagcacagtagagatggggtttcaccatgttggccaggatggtctcaatcttctgacctcatgatccgcccacctcggcctcccaaggtgctgggattacagatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaat

SEQ ID NO: 2146 - DNA, 575 bp, Homo sapiens
agggcacctcggaccccccagctgtccgcagcagagcccggccccttgcagccacagagccccggccgctgcaggctccaggagctccgcctggtcgccgccctgcgttcccgggccgcctcccgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttacc

SEQ ID NO: 2147 - DNA, 545 bp, Homo sapiens
gctctcggacccgcctccgaagacgtggagcgctgcggcggctggcagctgccctaggtacaaggagggaggctcccacaattgctctcaccattaactgcctgcctgtagatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaa

SEQ ID NO: 2148 - DNA, 2419 bp, Homo sapiens
gcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggagataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagct

SEQ ID NO: 2149 - DNA, 2450 bp, Homo sapiens
actggcctggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggaggctgcaagctgcaagctggtctctcttccacggtattcatggagcaccaactcagtgccaggcactgtcataggtcctggggtctagtcatggccctgctctctggagaccacataccagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcact

SEQ ID NO: 2150 - DNA, 2019 bp, Homo sapiens
ggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggagtgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgcca

SEQ ID NO: 2151 - DNA, 3717 bp, Homo sapiens
ccaggctccttctctataaagtgggatctatcatgaccagcctaccttatcaatataggagagaaaatcttcatgcctgaagatatacccctgctccctggctccccacgccggctgagccctcaggcagggtccagagggggccagggccccaaacatggacagcagtgtctcaagatgccaggtccccgggccccaggtctgcagggcggttccaacagagatcctggccagccctgcggtggagagagcacccgcagcagctctgtcatcaacaactatctggatgccaatgagcctgtgtccttggaggcccgtcttagccgcatgcacttccatgacagtcagaggaaggtcgactatgtacttgcctaccactaccggaaacgcggggtgcacctggcccaaggcttccctggccactcgctggctatcgtctccaatggggagacaggcaaggagcctcatgctgggggcccaggtgacattgagctgggaccgctcgatgccctggaggaggagaggaaggagcagcgggaggaatttgagcacaatctgatggaggctggactggagcttgagaaggacttggagaataaaagccagggatccatctttgtccggatacacgccccgtggcaggtgctggccagagaggcagaattcttgaagatcaaagttcctaccaagaaaatgtacgagatcaaagcaggaggcagcattgcaaagaagttcagcgcggctctgcagaagctgagctcgcacctgcagccccgagttccagaacacagcaacaacaagatgaaaaacctctcctacccattctccagggagaagatgtacctgtacaacatccaggaaaaggacaccttctttgataatgccacccgcagccgcattgtgcacgagatcctgaagcgcacagcctgctcccgagccaacaacacgatgggtattaactctctgatcgcaaacaatatctatgaggctgcctaccctcttcatgacggtgaatacgatagtccagaggacgatatgaatgacaggaagctgctatatcaagaatgggcgcgctatggagtgttctataagttccaacctattgacctcatcagaaagtattttggagaaaaaattggactgtattttgcctggctgggattatatacatcattcctcatcccatcttctgtaattggagtgattgtgtttctttatggatgtgcaacaattgaagaagatattcccagcagagagatgtgtgaccagcagaatgccttcaccatgtgtcccctgtgtgacaagtcctgtgattactggaacctcagctcagcctgtgggaccgcgcaggccagccacctgtttgacaaccctgccaccgtcttcttctctatcttcatggctctgtgggctaccatgttcctggaaaactggaagaggctacagatgcgactgggctacttttgggacctgactggcatagaagaggaagaagaacgtgcccaggaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggtttgtgggcaggcctggaagctacgtctatgtattcgatggttaccgcatggaagagtgtgctccagggggctgtctcatggagctctgcattcagctcagcatcatcatgttggggaagcagttgatccagaacaacatctttgagattggagtcccgaagctaaagaaactatttcgaaagctgaaagatgagaccgaagctggagaaactgactctgcccattcgaaacatccagagcagtgggacctagactacagcttggaaccatacacaggactgactccggagtacatggaaatgatcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggaatctggtttgacattctctctggaattggcaagttctctgttatcagcaacgcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtttaaggattaccgagagccgccatgggccccgaacccttatgagttttcgaaacagtactggtttattctgtccgcccgtctggcttttgtcataatcttccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaagatg

SEQ ID NO: 2152 - DNA, 3717 bp, Homo sapiens
ccaggctccttctctataaagtgggatctatcatgaccagcctaccttatcaatataggagagaaaatcttcatgcctgaagatatacccctgctccctggctccccacgccggctgagccctcaggcagggtccagagggggccagggccccaaacatggacagcagtgtctcaagatgccaggtccccgggccccaggtctgcagggcggttccaacagagatcctggccagccctgcggtggagagagcacccgcagcagctctgtcatcaacaactatctggatgccaatgagcctgtgtccttggaggcccgtcttagccgcatgcacttccatgacagtcagaggaaggtcgactatgtacttgcctaccactaccggaaacgcggggtgcacctggcccaaggcttccctggccactcgctggctatcgtctccaatggggagacaggcaaggagcctcatgctgggggcccaggtgacattgagctgggaccgctcgatgccctggaggaggagaggaaggagcagcgggaggaatttgagcacaatctgatggaggctggactggagcttgagaaggacttggagaataaaagccagggatccatctttgtccggatacacgccccgtggcaggtgctggccagagaggcagaattcttgaagatcaaagttcctaccaagaaagagatgtacgagatcaaagcaggaggcagcattgcaaagaagttcagcgcggctctgcagaagctgagctcgcacctgcagccccgagttccagaacacagcaacaacaagatgaaaaacctctcctacccattctccagggagaagatgtacctgtacaacatccaggaaaaggacaccttctttgataatgccacccgcagccgcattgtgcacgagatcctgaagcgcacagcctgctcccgagccaacaacacgatgggtattaactctctgatcgcaaacaatatctatgaggctgcctaccctcttcatgacggtgaatacgatagtccagaggacgatatgaatgacaggaagctgctatatcaagaatgggcgcgctatggagtgttctataagttccaacctattgacctcatcagaaagtattttggagaaaaaattggactgtattttgcctggctgggattatatacatcattcctcatcccatcttctgtaattggagtgattgtgtttctttatggatgtgcaacaattgaagaagatattcccagcagagagatgtgtgaccagcagaatgccttcaccatgtgtcccctgtgtgacaagtcctgtgattactggaacctcagctcagcctgtgggaccgcgcaggccagccacctgtttgacaaccctgccaccgtcttcttctctatcttcatggctctgtgggctaccatgttcctggaaaactggaagaggctacagatgcgactgggctacttttgggacctgactggcatagaagaggaagaagaacgtgcccaggaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggtttgtgggcaggcctggaagctacgtctatgtattcgatggttaccgcatggaagagtgtgctccagggggctgtctcatggagctctgcattcagctcagcatcatcatgttggggaagcagttgatccagaacaacatctttgagattggagtcccgaagctaaagaaactatttcgaaagctgaaagatgagaccgaagctggagaaactgactctgcccattcgaaacatccagagcagtgggacctagactacagcttggaaccatacacaggactgactccggagtacatggaaatgatcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggaatctggtttgacattctctctggaattggcaagttctctgttatcagcaacgcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtttaaggattaccgagagccgccatgggccccgaacccttatgagttttcgaaacagtactggtttattctgtccgcccgtctggcttttgtcataatcttccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaag

SEQ ID NO: 2153 - DNA, 3673 bp, Homo sapiens
ggtctgcgtccacatcatggcgactcccgggccgcgcgatatacccctgctccctggctccccacgccggctgagccctcaggcagggtccagagggggccagggccccaaacatggacagcagtgtctcaagatgccaggtccccgggccccaggtctgcagggcggttccaacagagatcctggccagccctgcggtggagagagcacccgcagcagctctgtcatcaacaactatctggatgccaatgagcctgtgtccttggaggcccgtcttagccgcatgcacttccatgacagtcagaggaaggtcgactatgtacttgcctaccactaccggaaacgcggggtgcacctggcccaaggcttccctggccactcgctggctatcgtctccaatggggagacaggcaaggagcctcatgctgggggcccaggtgacattgagctgggaccgctcgatgccctggaggaggagaggaaggagcagcgggaggaatttgagcacaatctgatggaggctggactggagcttgagaaggacttggagaataaaagccagggatccatctttgtccggatacacgccccgtggcaggtgctggccagagaggcagaattcttgaagatcaaagttcctaccaagaaagagatgtacgagatcaaagcaggaggcagcattgcaaagaagttcagcgcggctctgcagaagctgagctcgcacctgcagccccgagttccagaacacagcaacaacaagatgaaaaacctctcctacccattctccagggagaagatgtacctgtacaacatccaggaaaaggacaccttctttgataatgccacccgcagccgcattgtgcacgagatcctgaagcgcacagcctgctcccgagccaacaacacgatgggtattaactctctgatcgcaaacaatatctatgaggctgcctaccctcttcatgacggtgaatacgatagtccagaggacgatatgaatgacaggaagctgctatatcaagaatgggcgcgctatggagtgttctataagttccaacctattgacctcatcagaaagtattttggagaaaaaattggactgtattttgcctggctgggattatatacatcattcctcatcccatcttctgtaattggagtgattgtgtttctttatggatgtgcaacaattgaagaagatattcccagcagagagatgtgtgaccagcagaatgccttcaccatgtgtcccctgtgtgacaagtcctgtgattactggaacctcagctcagcctgtgggaccgcgcaggccagccacctgtttgacaaccctgccaccgtcttcttctctatcttcatggctctgtgggctaccatgttcctggaaaactggaagaggctacagatgcgactgggctacttttgggacctgactggcatagaagaggaagaagaacgtgcccaggaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggtttgtgggcaggcctggaagctacgtctatgtattcgatggttaccgcatggaagagtgtgctccagggggctgtctcatggagctctgcattcagctcagcatcatcatgttggggaagcagttgatccagaacaacatctttgagattggagtcccgaagctaaagaaactatttcgaaagctgaaagatgagaccgaagctggagaaactgactctgcccattcgaaacatccagagcagtgggacctagactacagcttggaaccatacacaggactgactccggagtacatggaaatgatcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggaatctggtttgacattctctctggaattggcaagttctctgttatcagcaacgcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtttaaggattaccgagagccgccatgggccccgaacccttatgagttttcgaaacagtactggtttattctgtccgcccgtctggcttttgtcataatcttccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaag

SEQ ID NO: 2154 - DNA, 1085 bp, Homo sapiens
ggaagagtgtgtgacttggtgaagcagctcccaagcacccaagatgcccaggagcctctggaagcagcagttggtccccagtgtcttcccctgaacccctaggaacatgtagggttcaagggctcagtcccagtctcagaggggaaaaggcatgtgagcgtgcaactggcagccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattcttt

SEQ ID NO: 2155 - DNA, 3717 bp, Homo sapiens
ccaggctccttctctataaagtgggatctatcatgaccagcctaccttatcaatataggagagaaaatcttcatgcctgaagatatacccctgctccctggctccccacgccggctgagccctcaggcagggtccagagggggccagggccccaaacatggacagcagtgtctcaagatgccaggtccccgggccccaggtctgcagggcggttccaacagagatcctggccagccctgcggtggagagagcacccgcagcagctctgtcatcaacaactatctggatgccaatgagcctgtgtccttggaggcccgtcttagccgcatgcacttccatgacagtcagaggaaggtcgactatgtacttgcctaccactaccggaaacgcggggtgcacctggcccaaggcttccctggccactcgctggctatcgtctccaatggggagacaggcaaggagcctcatgctgggggcccaggtgacattgagctgggaccgctcgatgccctggaggaggagaggaaggagcagcgggaggaatttgagcacaatctgatggaggctggactggagcttgagaaggacttggagaataaaagccagggatccatctttgtccggatacacgccccgtggcaggtgctggccagagaggcagaattcttgaagatcaaagttcctaccaagaaagagatgtacgagatcaaagcaggaggcagcattgcaaagaagttcagcgcggctctgcagaagctgagctcgcacctgcagccccgagttccagaacacagcaacaacaagatgaaaaacctctcctacccattctccagggagaagatgtacctgtacaacatccaggaaaaggacaccttctttgataatgccacccgcagccgcattgtgcacgagatcctgaagcgcacagcctgctcccgagccaacaacacgatgggtattaactctctgatcgcaaacaatatctatgaggctgcctaccctcttcatgacggtgaatacgatagtccagaggacgatatgaatgacaggaagctgctatatcaagaatgggcgcgctatggagtgttctataagttccaacctattgacctcatcagaaagtattttggagaaaaaattggactgtattttgcctggctgggattatatacatcattcctcatcccatcttctgtaattggagtgattgtgtttctttatggatgtgcaacaattgaagaagatattcccagcagagagatgtgtgaccagcagaatgccttcaccatgtgtcccctgtgtgacaagtcctgtgattactggaacctcagctcagcctgtgggaccgcgcaggccagccacctgtttgacaaccctgccaccgtcttcttctctatcttcatggctctgtgggctaccatgttcctggaaaactggaagaggctacagatgcgactgggctacttttgggacctgactggcatagaagaggaagaaccaagagttcaagaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggtttgtgggcaggcctggaagctacgtctatgtattcgatggttaccgcatggaagagtgtgctccagggggctgtctcatggagctctgcattcagctcagcatcatcatgttggggaagcagttgatccagaacaacatctttgagattggagtcccgaagctaaagaaactatttcgaaagctgaaagatgagaccgaagctggagaaactgactctgcccattcgaaacatccagagcagtgggacctagactacagcttggaaccatacacaggactgactccggagtacatggaaatgatcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggaatctggtttgacattctctctggaattggcaagttctctgttatcagcaacgcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtttaaggattaccgagagccgccatgggccccgaacccttatgagttttcgaaacagtactggtttattctgtccgcccgtctggcttttgtcataatcttccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaag

SEQ ID NO: 2156 - DNA, 6651 bp, Homo sapiens
agagcgcccaggagcgctaccggctgagggtggggaagcgcagggccaagcgcgcgaagcaggttgtgggggaccgggtcgagtggaagtacccgccggagaggaaggccggctggctgtggcgcccagagacggtggagtccgaggaggaggagaaggaggcctgcagaaggaagagcaggcccttagaagtccagcagcagcaactccggcggcccacagtcagattcagcacctgcctcagatctccacgtctgtctcagctgcccctctcctgctgcctctcaggcaccagtgccattaacgagctggcgaagatgggcgacccggatctcctggaagtgttggcggaggaaggggaaaaagtcaataagcatatagactactctttccaaatgagtgagcagagcctgagcagcagagagaccagctttctcatcaatgaagaaacaatgcctgcaaagcgattcaatttgttcctgaggcggcggcttatgtttcaaaaaaatcagcaaagcaaagattctatcttcttccgagatgggattaggcaaattgattttgtgctttcctacgttgatgatgtaaagaaagacgcagagttaaaggcggaaagaagaaaagagtttgaaactaatctcagaaaaacaggtcttgagttggaaatagaagacaaaagggactcggaagatggaagaacttattttgtcaagatccatgccccttgggaggtattagttacctatgctgaagtcttgggaatcaaaatgcctattaaggagagtgatattccccgccctaagcacactcctataagctatgtgcttggacctgtaagactcccactgagtgtgaagtatccccatcctgaatattttactgcacaattcagcagacatcggcaggagctcttcctcatcgaagatcaggcaaccttctttccatcctcatcaagaaacagaattgtgtactatattctctcaagatgtccttttggcatagaagatgggaagaaaaggtttgggattgaaagactgctaaactctaacacttactcatctgcctatccactccatgatggccaatattggaagccatcagaacctcccaatcctaccaatgaaagatacacacttcaccagaattgggctcgattttcctatttctacaaggagcagcctttagacttgattaagaattattatggagaaaaaattggtatctattttgtctttcttggattttacacagaaatgctattctttgcagctgtagttggcttagcttgttttatttatggcttattatcaatggaacataacacaagcagcactgaaatctgtgaccctgagattggtggtcagatgatcatgtgcccactctgtgatcaagtgtgtgattattggagactaaatagtacgtgtttggcttcaaagttctcccatttgtttgataatgagtcaacagtgttctttgcaatattcatgggaatttgggtcaccttatttttggagttttggaaacaacgacaagccagactggaatatgaatgggacctggtggactttgaagaggaacagcagcagcttcagctgagaccagaatttgaagctatgtgtaaacacaggaaattgaatgcagtgactaaggagatggaaccttacatgcctctatacacgcgtattccatggtactttctttcaggagccacagtgacattatggatgtctcttgtcgtcaccagtatggtagctgtaattgtgtaccgcctgtcagtctttgctacatttgctagtttcatggaaagtgatgcatccttaaagcaggtcaaaagcttccttactcctcagataaccacatcactcacaggatcatgcttgaactttattgtcatcttgatcttgaatttcttttatgaaaagatatctgcctggatcacaaaaatggaaattcctcgaacataccaggagtatgagagcagtcttaccttgaaaatgttcctgtttcagtttgtaaatttttactcatcctgcttctacgtagctttctttaaagggaagttcgtaggctatcctggaaaatacacatatttatttaatgagtggagaagtgaagagtgtgatcctggaggctgtcttatagaattgacaacccaattgaccattataatgaccgggaaacagatttttggaaacattaaagaagccatttatcccttggctttgaattggtggagacgccgaaaagctcggacaaactctgagaagctgtatagtcgatgggagcaggatcatgaccttgaaagttttggaccccttgggcttttctatgagtacttagaaacagttactcaatttggatttgttacactatttgtggcctcttttcctttggctcctcttcttgctctcataaataatattgtagagattcgagtggatgcctggaaacttaccactcaatacaggagaactgtagcttctaaagctcatagcataggtgtttggcaagacattctttatggaatggctgtcctttctgttgcaactaatgcctttattgttgcatttacgtcagacatcattccccgtctagtttactactatgcttactcaacaaatgccacacagcctatgacaggatatgtgaataatagcctgtcagtattcctgatagctgattttccaaaccacactgcaccttcggaaaaacgagacttcatcacttgcaggtacagagattacagatatcctcctgatgacgagaataaatattttcataatatgcaattctggcatgtccttgctgccaagatgaccttcatcattgttatggaacatgttgtgtttttagttaaatttttgctggcctggatgatacctgatgttccaaaagatgttgtggagagaatcaagagagaaaagttaatgactatcaagattctccatgattttgagctcaacaaattaaaagagaacttgggaattaattctaatgaatttgccaagcatgtcatgattgaggaaaacaaagcacagctggctaaatcaacactctaatcagtatagtgaggaagcagcaggtgatctgccttacttcactttatcctctggttttagggccagacgccagaagccatgtgtcaattttaccctttcttttttttttttttctttttttttttaaactcaaagtttttatacacttttatagaggccaactttgtgatgttggaaatgtactacttctctgcttcattgactgggccctctccagatgttgttttctgaggtgctgtaaatgactgttgaaagtgcaggtagaatcagaatactgggaaattatggagtcttgcagtttagtaagaaacactggccttgggctgtcccatcactttccagtgcatctatttatttttgtggtcttctcttgggttatttgatacctccttccccattaagaaaaatgttggggcaaaaagaaatggatcaaagagactgactgagccctatatatcctatcattttaaaatatgcaaatgaattgccaagatcagatgacataagaaaactcacacattaaggtgttaatgtatcatagcagaggtttattcctaacacattcaactaccatcagaatcccagatagttcttcctggtaaaggcagaattccttttctcgagactgaaattttgggtttcaacataaaacaacttggttcttagagataataatttggttataatagtttcaagactgatcttatctggaaagcaacattatgaagctgttagattgcttcaggttctcaagcaaagacacaatacagaagtaaatgtgttttcttagtagttaatggatgcaggacaatgtatattgattaatttgttgattttaatttagaaaattgttaaattatttcttaaaaatcacttttcttctggaatgccaatttcacatcatgaagcctttttgtataagttagatacgagttgtttatgataaacatttctttgctttaaaataattgcaaatattttaataagtttacaaccttttctattgatgtatcatcttatacaatgctcagtgccttgttccaatacctctgacacacaagaagtcatgttgttagctagtgatttgatgtgatgtaacatcttaaatgtaagcttgtcttaatgaaattgtcagtgtaataacaactacagtcttgaaaaccaaaagtgaatcaaccaactaagaatgagttcatggacttaataatctaagggggaaaaaatgtttgttgaattattcctctcaaatttaggcttgtgttacatgcacaaaaatccttgttctgttttcacttaaaaaaactaaatatgtataactttgtgtatacacacacacacatctatatatataattattagcactagagggatatagtccagttatgtagtatttaaatctccagtttcaaattataattcacctccaaaagaatagttttttaatcacacacataagaaattttatcacaatatttaaaactaatatttcattatctaatgctaataaattattgtggtactgccagtattaaatatatggcagatggtattaactactgatcaatagtaagcatacagaactggggattatggattttataaactatgagacagtcaccccagtttggactgggactaatccccagtactgatttgtcatccactgagtagactttatgaatattttgggtaatttgaaatgatctcattattgaaagatgatttcatatgtagagaagataatatttctttcttgaaaaaacaagtcaggcttaccatgatgtgtgcaaccaatgtaggatctttggcttgtcaaatcagattctccattgctatagtgtacagtgcacacagctcatattgcttccttcctgggtgctgataaaaataagaaagagcatggaaattggtttcttgaatataagctttaatttttaaggcttaaaagtattcatagaggtagactgtatgataaataaaaacaaatttaattcacaaagttatctgtacactgcagttttaaaatataccaactaaattattgggtttctggaagtgaatggagaaaacagcaagggaagaaatcgtttttaagataagtaaataattcccatggattgataaatattttccttttaaaatgttatggactgatattttttattcacctttaaatttcttatcaagaagtttatctttgtttttcagatttaaaaatgaaatacaggtattcgtcactttcctgaaaccatgctaaccaaaatcagtagccaaaccaattcagatagatgtgtctcatctaattaaacccattggtttttatgggagggctgcattaagagcacccaaccaccacatgtaagttgataattaccagcatggcaggtgattttatctgctgaccaagcgcatagttttgttttgttttcagaatgttctagggaacatttgagattttatgtgaaataaaattttaagtgccaaagccaaaaaaatacttaactcttttcaaaggccctctttcatccttgccttcgtcaactttcctttgcacacaggaagcaaaatctacttcaagacatttattttagaggaatccattaagaaaggattgttttacttaaatgaaatgctgtcttatttttgctgtgtcttttgacacctcttagctttaacattcttcttttaaccaagccattatgcaaagttatcaaagaagaggagaaggaaaggaggacagatgaaagtgacgggaaatgagaaagaagaggagtgaggaaacagttatttccttatgaatcctgtgtgtttctttggaagaaagagctgttccgaggaagtttggtccagctgtggttgataagaggtatatctcttaaaaaagacacctaatgaaagtgagagaaaagctaaagaaaatttcaatgtgaccactattatgtgtcaaaataaaacttagattccaaagtggttttgtagtgttgggtgctatgagtaggtatggatctctgttgattgactccagttgaaggtgagaaatctgtaccaatcattcaaaaagggaatctattgttttgaaagaaactctctcatatttcctttaaattgttaatagttgttatgcaactaaagaatgttatgaagaaaaatagcattgcaaaaagtaccattggccagccttacaagtcagccacaatgagtcggtataactactgtgttattctttttctagacaaattttgactcttctacttttatgtgtaataattccagtattctatttatttcagcattatgtgaaaaatgataagaatgttaaaaagaaaataatagtgtggtttaattggtatgagatacctgcttcctcctcctcaaaggtttgactgggtgtatctctcctatgtgtgacattatgtctcctggtgttaacacaggaaatgagtgctcctttttaaaatttctttcttccaagtttttttttccaggaagagaaatatgcagttatgcaggaaaagctctcttaaataatgtgtacataaatctcaagagaatcaaattcacagagtgaataaagtaataatattaaactaca

SEQ ID NO: 2157 - DNA, 5975 bp, Homo sapiens
gagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaata

SEQ ID NO: 2158 - DNA, 3558 bp, Homo sapiens
cttctgcgcgcctcgtaaaaccggggaagttcaatcattccgcagcgagccgcggcggccgcactgggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagtatctcgctttgttgcccaggctgggacacagtggcatgatcttggctcactgcaacctccgcctcccagttgactgctgtatgtgttataggtttgtcgatgaaattagacttttggaacaactaacttctgactttattgactccctctattatatattttctatttcaataatatctattttcttttctgttactttctttttccttctactttctttggggccaactccgtgtttttctgtatcgaatttcttaagttagatttattcaataattcattcaacaaatatttgtgtgtctattatgtggccagcattgtttcatgtgctcaagatagagtagcattgtttggctcattaatattccaatactggcatttaagaccattaattttcctctaaatcgtatttgagctgcaacccacaagcttttatatgtatagttttttgttgttgctattattaaaagtattttagatcctcccttgttttgcttttcaatctgaaatgccttcatgccattttaatttttaaaaggtaatttaattgagcctaatttctttttcttttttcttttttttgagacagagtcttactctgtcacccaggctggagtgcagtggcgtgatctcagctcaatgcaagctctgcctcccaggttcacgccattctcctgtctcagcctcccaagtagctgggactacaggcgcccaccaccatgcctggct

SEQ ID NO: 2159 - DNA, 3448 bp, Homo sapiens
tcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccgcccccaacttcgcgccaagttcggagccgccttctgagggagacatgaaaaagatgagcaggaatgttttgctacaaatggaggaggaggaggacgacgacgatggggatatcgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagtatctcgctttgttgcccaggctgggacacagtggcatgatcttggctcactgcaacctccgcctcccagttgactgctgtatgtgttataggtttgtcgatgaaattagacttttggaacaactaacttctgactttattgactccctctattatatattttctatttcaataatatctattttcttttctgttactttctttttccttctactttctttggggccaactccgtgtttttctgtatcgaatttcttaagttagatttattcaataattcattcaacaaatatttgtgtgtctattatgtggccagcattgtttcatgtgctcaagatagagtagcattgtttggctcattaatattccaatactggcatttaagaccattaattttcctctaaatcgtatttgagctgcaacccacaagcttttatatgtatagttttttgttgttgctattattaaaagtattttagatcctcccttgttttgcttttcaatctgaaatgccttcatgccattttaatttttaaaaggtaatttaattgagcctaatttctttttcttttttcttttttttgagacagagtcttactctgtcacccaggctggagtgcagtggcgtgatctcagctcaatgcaagctctgcctcccaggttcacgccattctcctgtctcagcctcccaagtagctgggactacaggcgcccaccaccatgcctggct

SEQ ID NO: 2160 - DNA, 5955 bp, Homo sapiens
ttggggcagaggaggcttgtaggaataggggaagagttcataagcagagctgaaacaacaccaaacatggaaatgttacaaggtggagaaattgtgcttactgaaactcttctcagaaatattgctgtttgtggatgatagaaatcttcagagttgtcacttaaggtagaggtaggagggtaagaagcgtcaaggactcaccgaattgtccattcccccttttgttctgctgtggaatgttttgtgctgctgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaata

SEQ ID NO: 2161 - DNA, 5504 bp, Homo sapiens
gggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcggtgatgttcctgcctccaggaggccttttctgactcctcatactcacctcccatccagcctggtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggca

SEQ ID NO: 2162 - DNA, 749 bp, Homo sapiens
aaacatccagaatacatttccaacaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataagagatgatggaaaaaagccttcacttcaaagaagtcaaatttcatgaagaaaacctctggcacattgacaaatactaaatgtgcaagtatatagattttgtaatattactatttagtttttttaatgtgtttgcaatagtcttattaaaataaatgttttttaaatctgagactgac

SEQ ID NO: 2163 - DNA, 663 bp, Homo sapiens
ttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcagggaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaac

SEQ ID NO: 2164 - DNA, 2353 bp, Homo sapiens
agcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgt

SEQ ID NO: 2165 - DNA, 1713 bp, Homo sapiens
aggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 2166 - DNA, 1501 bp, Homo sapiens
ctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcagggaggtgttccgctttgcctactacaagctgcttaatttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgact

SEQ ID NO: 2167 - DNA, 4189 bp, Homo sapiens
accgaaccccgcccgcgccgggagcatctcgcgtccccaacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcacttggctttcacacaactgctctccgaaaggggtgctcagtggtgtgcgtcctggctgcacgagaatcacctgggacagtgtaaagccgactgattctgggctccaccttccagagctaattggcctgggcacgtggtgagttttaaaagcttcccaggtgattctgatgtgcagccatgttgagacccactggtttggtatccaaataggagcttcctgagaacaccttaagtggatgagaatctggtctttagctgtctcctaactcaactcgtgctgagcaagtaagtatctgaatgtcaaatcctggttatcttttatcttcctaagttctgaagtcacaaaaggctaaagggctatcacccctgctcactgtttgcgtgtacttcaccatcttaggagaacacggtaggttgggcttctaaatgcaataataaattacgctgactgtggtaacttagccaaagtaagatactgattaagccgtatttttctgaagtgcttccattccaggttttgctttctgaggcattacattgtttttgagtatagattacattttattaactaaaaatgattgttttgtgacttccttgggaaggtattttaaaatcaggaatttttatgcaatgtctataagcctgtttaaagctttccatgggctctgccccaaggccgttggctgcagcgttcaccatctgagtgccagttgctggactagttgaggtgaagtgcattgttttctctctgagcagctgtgcggggagctgagtgatgtgccctgggacaggcttcactggagctggtggaagtataaccagaagcacaaggaaatgagccaaaagggtgtcattgacacttttcatttgctcctgtgatactaacaacactttcacccaaatggcttaatgtaatattggaaatagatcttaaactgccaaatctcacactattgcataatccatatgctctttagatctagtcagtgtctctgggttttggtagcagatacagcgttccctttacaggaatacccaaggtgttctttcagcttccagacaggtcctttgatttcctttataaagggaaaattctggcaaatcgtgcctttactattagaaattgttcccagttgatgtcttttggggagctggtggcatgaaatgcaaatgacctatacattaaagtgatgtctcagtgaataccatacatgcagtagaacattcagaagagaggagcagcaatcctgaggggctgggggagtgacagtggcaggacggatgggcgggtttgacagattgtggtgggaagaagaatgatcatgtttaaagctaacatagccagtgttttgggctagccacacatcattccagagaccaaaaccttactcatgaactagacctttatcgatatcagtgaacccccatgtttaaaatattagaatgtttagagataaaatagagataatagagataaaagaagaggagggcttctatcaatgctgtaaacagtctgataagcgactgtggttattcccctaaagtttacttcagcactaacactagtgcttccgctggagtttgcagttttccagctttatacaggattttcctttgactggaagagtcaaggatatagagactcaacagtgacatttattgtacaacatcaaggggaataggatactcatcaaactgggattattcttatcaaaacatggtcttctttgaataagaaaaatacatagttggttattatggacttaaaactgtgttaaatggatattctgataaaatatttgctgctctgtagagtgtggaaagtctgagaatattagctttactcatcttgagctttgaggatgttctctgtacgccgatggtttcatattaactaaaaaagctgggtattgtaaaatctcatttataaaaactcagatgagaagaaaattttctttgatggtgagactgttgtcttagttcaggaaattatttaataatcctttgttacctgtgaatgaaggaactttgtaattctgatttatcgtaaaacatgagcctttccagagtcagcttagacactgttgtcgcaaatagccatgctttgccttatgccaaggaggcccagagggagggcctagtcttcctctgttgctgtacatatattgaaatgcttttttttttttattttgcatttgttatctataatgagctttctgagccctgatattatgtgagacaaacaggagttattgatgttatacactcccttccattcaggattttctgcttggagggaaatatgttgaccttagagaattgtgaatattgttgcaattcttgaatatattaccatgtgaataatagagactgtgttgctctctagtataagctatatttatttttgattcatttgaattactagttataactggagaaattttgttacctctatcctggcttgcctgactggctgtataatagcagcagcctcttttagagcatcttaatgaaaacatggatgaaaggaattaatgatgatatctgcagactgcgtagaaaatggcttttgttcccagcgttaacattttcttctcaatcacatttcaatgtttgtggagagtggcagattcacaccagaaacactaggtgttcatatccatagcatggatgcagaataagcagttgggagagaagcttcttcctacctggtactcctcccattcacctcagcccagccccagacaggcgttagcattcagtgtgggccctcaggcagccctgaagcctggctgggtcatcagatgggggcagcctgtgacgggcaccagcggcctgattccagggaagagttcctggagggtgttggctgtttttgttagctcagtttttttctgggctccaccattcctaactccaggtagacaagatagatgtcacacacaacaattttaaagtattttgcttagtgcattttgtttatgattgcagtgtttgtttcttatttaataggctttttacttcattctattaaattttagtgtttagaagaggcgggtactgtcactgtgtaaaatatgtaatattttatatgttataccatgtcatatatacttgcaatatcagaccttgcattcaatatacaatgcaattgactctttgcagacctgcatttttcagtgaacaataaaaagattgtctggcactcctca

SEQ ID NO: 2168 - DNA, 872 bp, Homo sapiens
tttccgcggtggccatgactgcggccgtgttcttcggctgcgccttcattgccttcgggcctgcgctcgccctttatgtcttcaccatcgccaccgagccgttgcgtatcatcttcctcatcgccggccgaagggtggaaacctgtaaaaacaccgaagcacctgactgtgcgtctccttctgggagcttgagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttc

SEQ ID NO: 2169 - DNA, 685 bp, Homo sapiens
tttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttc

SEQ ID NO: 2170 - DNA, 5859 bp, Homo sapiens
gacggaactccttccattgcaaaagctcggcgcggcctcgggagctgcccggcggccccggaccgaggcagccctcccctttaaaagaagcggaggacaggattgggatccttgaaacccgaaacccagaaacagcatcggagcggaaaccagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacacctcctcgccgcctcctgcccccatctacactcccccacctcctgcgccccactgccctcccccgccccccagcgcccctacccctcccatcccgtccccaccttccacccttccccctcctccccaggctccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaactcttttttctggttgtctgtttgttataaagtgcaacgtattcaagtcctcaatatcctgatcataataccatgctataggagactgggcaaaacctgtacaatgacaaccctggaagttgcttttttaaaaaaaataataaatttcttaaatcaa

SEQ ID NO: 2171 - DNA, 1384 bp, Homo sapiens
aggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaaaataaaataaaataacaagaagaagaaagaaagaaatcccacagaaacagataacctaacacagcccgtgcaacgtattttatacaatgctctgaaaatcatagtctcaatctagacagtcttttcctctagttccctgtattcaaatcccagtgtctaacattcaataaatagctatatgaaatcaaa

SEQ ID NO: 2172 - DNA, 2221 bp, Homo sapiens
gaaacagcatcggagcggaaaccagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgtagcctccacaaaattgcatcaggccccacaacagctgcttgcatggaatagcagagaataccgcctgctccctccggacagcacactcctgaaaacggggagagaggagccaaacatgctcggtttacactttccttatttactgaatgagtggagggcagagacaggcctggagttacgcacactgagtgccccaacatggaaagaaacatcaggagggacaggaaacgttccctccttaaccaacagttttcaagaccttactggaggcactttattggctacataatcactccatgcggtgggcatcaggcagaatcctggtgcagacccaactttgaggtggaggatttcacagtttctttattttgaacttcccccaggctcccactaattcctctccattctatcctcctccctttcccacaaaagaaaacagaaaggagcagcagtgtttgataccgtatcatccagaggcctggttctctcccattatagggcaaacaagccctggcaagatatttcactcccgccccatgccatgcattaaaaatccaaaattgcctatattccacctgccaagcaagagatgctttcattattgaagttccaaatgtatacctttgagaacagtgccttctcgtcttaaaagagaggtcctcattttgtgagttgggagcagagggaattaaagaaagccatgatgcagggatttggccattcaagccgggcagccttcagagaatgtcatccctaatgacacatgcccgaatgaaggagcggggctgagcttgtcctgccttcgtattgaatgttgcctgtctgcctccttaatagcgggcctctgtgtgagcatttgacaagacttaaaactattcattgaagaaaatggatgatcccccaacaggaagatgcaaccccatgggctgcctgcttgaccacagaagtgcttccagctccagttgctcatctgagaactccccccaccacttgctgttaaaattgttaaaattaaaggccatgttgattgattttttaaactttatttccattttttttaataaaataagaattgg

SEQ ID NO: 2173 - DNA, 1732 bp, Homo sapiens
agtcatcttcaactcggcaggaacccacaagtgtgcatgtgtggctcggaggcttcagctggggccccgccctcgtccccaggcgcacactgacacacgcagcccagacccggcccgagcgggctcctgccctcggcgtggcttctctccagccgggagtcccagggccagctagcctcctcccctaaaggggacggcctgtcagcgcagtgccagagtccagcaccgggaggaaagtttcggagtgcggagggagttggggccgccggaggagaagagtctccactcctagtttgttctgccgtcgccgcgtcccagggaccccttgtcccgaagcgcacggcagcgggggggacttcagccctccaggcggggtgggttccaggtccgggtccgaggcgggcgctggaggctcggccccaggccggagaggaactcctttcgcgagctgtcgccgtgggcccgcattgtctgcaggaactctccggaatcgggagggggaggactggatcgcgcttccactgggattcgtcaagagttccggcggcagctgcggcggtggcggagactccctttgtcctctcaggacctccctctctccctccctgtcagctggtgggtcccgctgccgcaggcgccggcgtctcagctgctcgccgccccccaccccagagtgcgtgccgggtgactcccgccacctttgcgaccctcctgagcttaggggactgcgagcgggagggagtctcaggcccccggccgcaggatggtggcggagcggtccccggcccgcagccccgggagctggctgttccccgggctgtggctgttggtgctcagcggtcccggggggctgctgcgcgcccaggagcagccctcctgcagaagagcctttgatctctacttcgtcctggacaagtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagagtggggtctcactgtcacccaggctggagtgaagtggcatgatctgactcactgtacttttggcctttctggctcaggtgatcctcctacttcagcctcctga

SEQ ID NO: 2174 - DNA, 1473 bp, Homo sapiens
aggatggtggcggagcggtccccggcccgcagccccgggagctggctgttccccgggctgtggctgttggtgctcagcggtcccggggggctgctgcgcgcccaggagcagccctcctgcagaagagcctttgatctctacttcgtcctggacaagtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggcccctttgctgcaaagtggttattaaggatcctccaccaccacccgcccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgaggtttgtatatgggaatgtattgagaaagagctaactgcttga

SEQ ID NO: 2175 - DNA, 1343 bp, Homo sapiens
cgctgccgcaggcgccggcgtctcagctgctcgccgccccccaccccagagtgcgtgccgggtgactcccgccacctttgcgaccctcctgagcttaggggactgcgagcgggagggagtctcaggcccccggccgcaggatggtggcggagcggtccccggcccgcagccccgggagctggctgttccccgggctgtggctgttggtgctcagcggtcccggggggctgctgcgcgcccaggagcagccctcctgcagaagagcctttgatctctacttcgtcctggacaagtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattcttctaacgggatcgcagccatcattgttattttggtgttactgctactcctggggatcggtttgatgtggtggttttggcccctttgctgcaaagtggttattaaggatcctccaccaccacccgcccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgaggtttgtatatgggaatgtattgagaaagagctaactgcttgagtcagtataatggaggcagggaaatagtaataaaaaatgatt

SEQ ID NO: 2176 - DNA, 8273 bp, Homo sapiens
tttcggagtgcggagggagttggggccgccggaggagaagagtctccactcctagtttgttctgccgtcgccgcgtcccagggaccccttgtcccgaagcgcacggcagcgggggggacttcagccctccaggcggggtgggttccaggtccgggtccgaggcgggcgctggaggctcggccccaggccggagaggaactcctttcgcgagctgtcgccgtgggcccgcattgtctgcaggaactctccggaatcgggagggggaggactggatcgcgcttccactgggattcgtcaagagttccggcggcagctgcggcggtggcggagactccctttgtcctctcaggacctccctctctccctccctgtcagctggtgggtcccgctgccgcaggcgccggcgtctcagctgctcgccgccccccaccccagagtgcgtgccgggtgactcccgccacctttgcgaccctcctgagcttaggggactgcgagcgggagggagtctcaggcccccggccgcaggatggtggcggagcggtccccggcccgcagccccgggagctggctgttccccgggctgtggctgttggtgctcagcggtcccggggggctgctgcgcgcccaggagcagccctcctgcagaagagcctttgatctctacttcgtcctggacaagtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggcccctttgctgcaaagtggttattaaggatcctccaccaccacccgcccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaaggtacgaagatggcacattttcacatagctgattttcaaccaaatgaaaaaaatcaagtgcatttcagaagcttttggaagagcagcttaattcctctcagtcgggaaatgttttctctgccttctgctttgcttgcaccaaacatttctaaacacttgttctgccatctacatgggaggtgatgaaactcagtggtaactcatgatttatgacattgaaaataaagaggaacattgacctgcagactatggtttgtacaagaaagtttgtttgaatgtgtagaagaggaaaaagcaacaacagcaacaacacgaagatgataccaaaacaaggaccacaaaacaactagccatgatgggagacaggagttttttacatggaaacatggcacttgtgtttttatgtggcaagatctttatccataggcagagtatgaaatttcccaccaggctaagcaaataaagaagtccattgccttatagctatgtcagatcacagaatccttccaagtgctctatcacagtgtgccttatgggaagtttctgactggaaaatcttgtcattctaacactgaaaagtgcacacgcatgacaaaatgtagacaagatgcctcaaggtattggtagcaagcaagattttgccctttagttttcgaagacacctttctttcattatgcactcgggacaagaaaattaatagagcgttattccacagaaggcctctagccagagatcttgagtgtagtgcaagggactcattttttgcgaacttgtccctgtgactagtagattcccccttttcctgtgtttaggatttagtagtgcataaagcattaatatccataaacatacctagaagtttgttttgcttttaatttaaaggaagcagtaaccacaaagcttccgctcagggttttttctttcttcaagtctccaagggctcttcagcgtcacaagccagcaactctctttgcattaaaatttcaaagtttaattaatataattaaaagcaacagcaagcagcagcctgtgaagattttgctcatcttttttatgccttttgacattgaatgacctattactgtatgcgcattacttggattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcagaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgacactaaaaataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacacacaaatatataattttctatacatatatatcctctagcttgaaacttttgctcaagtttatttatgtcactggctggctggatccaaagtcatgtgtccacacattcataaataaaaattttacctatgcctgtgctaccatttctttaagcccacataaagctaatgccttcttgggttgaatatgcagttgttatgcttagtttcagggatggaattctattcagttccaaaatgtccctcatgttcacagatgatactattggcagtagctgcatatgcaagtgtaacttggaagcctgatatagtatacccaaccctttctgcaatgagttattgtatccctttgttctgcatttgcatctggaacaagacctaatgtggcttccttaaatgggcacttcatttctgatgagtgcacaccaattattgctattttaatatcattgagaatactacagaagctaaggctatgtttctttggtaactacttcaaatttctctagaattatgtagcatacttacattttgctgcatgaacaatgaaaattaacctctgcctttaaatggaaaaataactttctgtagattgttatacagctactatgaagagctcttaatgaagaggaagtggcagtggtctatatgtagactgaaaaaatatcattaataaagttcaaagactgatggaatttcattgcccttaaagatatgaaccagatctgttttatgcttttctccaattatactaactagcagttgaaaagaatttgttttgaagagtgttattttcttaccaaaagaccagatcaaaaatccctatacttttccaccaaaaaaagattaaaatgaagccatttctataaatttaatggcactttatattttatatagagaaatagcttctgtttgattttctggacaccatgtcagtcaagatctactttctgtgtaaaaatgaataagtcttgcacataatccattcgtgttgcataaggttgcaaaaacaattaagtgggaaatgactcctaacttatgtgtctactctgcctagaaagaaagttttgaaggcatctatatatatttcataacaatgtctgttctttatggatttgatccataaatatttatctatctgaaaactttgatacttggaatgttttccttagagcatttggtgctccaagaaaaaacatttggtgctaagagttgcagcactgatgcctttccctaagttaattctattttaaaaatttatatttccttcccaatgagatgcagagtaaaatttgagaccctccattgactagggagcagcatctgtcatctatggttaattactattttgacaaaaatatagaaggtttaaacccccatgtatttcagattgttagagaaagaagtagtttgcttatatttcccttgaactttattctaaccatttaaataataaattattcaatatttgttataataaatccttactagatacaagatttgggtgtttctgtgaagttaactttattatctaaatatcactaaccattgtttactgctcagaggcagatacatttgtttagtttaaagttgaaacaaattctatattgtggataattaggtgtttaaaacattttgatagaccagcttatatatgttatttttgaaatttaagaaggcagaatgtaattaggtcacatttacaagtagaaggaattataacttcctactccatgcatatattgtatattggttagcttttactagcattttctagcatcacattactttagaaagtttttgagagtttcattactactggaaaagtttggtgggtatatgtacacaggaaagaaatatatgcatcatttcaatatgaaaggaaatacataatctagaaacatagaataactcttggtacatctgttacatagttaaggaaagaaacaggcaggtgaggctggagaatgttgtctatttgtaggaaataaagtcagtgcagacgcatattctagtttagagttagattaatattgtgcttagtgaatttctatgacatatttctgagaacactttaatatatttccacacctactggaatctaattcagtcgatcggataaaagaaagacttttttgttgttgtttttgaaaatccataatgtagcaggttctgcgctggttttttaatgtattttatttttgtgctctcctgccaaaagaaaaggctgataagtaagtacacagtacaacatgtaaatttgtataaaaatatgcttgtttagattgctctacaataactatattaaggtaaattgtgtgtgtgtgtgtgagagagagagagagagagagaaacagagggagaattgactcaatgtgttttctatgaagagtcttagcttaggaatcaggtaacagagaggtcctagaccatagacccagccatcaactagcttgctgatgttgaacagatcaactctcaaccatagactgaagatggaatgaagatatcaaaagttccttttagcactgactagattttttttcttttttttgaaacagagtctcactctgtcacccaggctggagttcaatggcatggtctgggctgactgtaacctcctcttcctgggttcaagtgattctcatccctcagcctcctgagtagctgggattacaggcacataacaccacacccagctaactcttgtatttttgtagaaatggggtttcgctatgttgctcagactggtctcaaacacctggcctcaagtgatcctcctgcctcagtctcccaaatgctgtgattacaggcacaagctactgcaccaggcctctgactacatttctattaatatggttaggttggaggttttagtatttttgtatctcatatttgtatcaatatgactggcttctttgtctgtagtgtgtggtaatattagttctgtaaactgtcagttgcaaaaaaaaaaaataccttgaactatagtatatgttgataattagccataataatttcttagttaatttcttataattaaatttgtcaaagaggaaacttacagtttatatctgatgaaatctctaaaaagatgggtaaaacattgggaaatgtatgcatgtacttcactctggtttcatagggttagcaagtgtcttaaaaacatatataaagaagcacagagattgttaggagatatttatgctcccagttttaataattgggatactttgtataccacagaaagaaaaattactaaactcctctttttttagtcaaaattggaaaaaaagtcttaattgacagttactatgcctgtgctacccatagcaagtattcagtggaaaatactttactaagtaagtaatttgaacacagcttaaaatccatagtatgttacaattgctagcctttcacaaagtttgcattgtcttaatgtagaaggatactgtgatctaagaattcacaattttaaaaagtggaacctaaatagggtttcctaattgccatgaagttatttgtatcttagatgaattatatttacaacattgtaaatgtcagtgggtgatccaaaataaattgttaaagttattaaaatgtacatttaagtaggtttcagtttgactagaaataattggcaagaaggcaagaactagtcttctagagcagggatcccatcccccaggtcatggactggtactggtccatggcctgttagaaaccaggccacacagcaggagatgagtggaaagcaagtgaaacttcatgggtatttacagcaattccccgtcgctcgcattaccacctgagctgtgtctcctgtgagatcagcagcagcattagattctcaaggagcacaaacccttttggaactgtgtgtgagggatctaagttgcgcatttcttatgagaatctaatacctgatgatctgttgttgtctcccaccacccccagatgggaccatctagttgcaggaaaacaagctcaggctcccactgattctacattatagtgagttgtgtaattatttcattatatataacaatgtaataataatagaaataaagtacataataaatgtaatccacttgaattatcctgaaaccatccccaccccccaccccccggtctgtggaaaaattggcttccacgaaactggtccgtggtgccaaaaatattgggtatggttgttctagggtgtagactatgaaaaagatatgcattgtctccatgaactaaaaggcaaggtgattttaaacaatttagatgccaaacaaagaaaccaaaagcttccaaagtaataaatgatagagaaaggaaattgttacatcatgtgccaaattagaagcaaatctaaacttcttatcatgtactccaccatctgatttgtataagtaattggggaaagaaaaactcacaatataaaacaagattgactagttctagcagatgacacctgtaaatagaatttttactagttgaaattctgatgtgaaatgaagccattattattatcacaataaagtgttctttttagttctttttttaata

SEQ ID NO: 2177 - DNA, 3963 bp, Homo sapiens
cacttaaggagctcgggccagcgcgagggggagcagggaggaagcccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcaggggtgacagctctggggaaggggtgtgtgacaagagccccctggagagatactacgactacagcggggccttccggtgcctggcggaaggggcaggggacgtggcttttgtgaagcacagcacggtactggagaacacggatgggaagacgcttccctcctggggccaggccctgctgtcacaggacttcgagctgctgtgccgggatggtagccgggccgatgtcaccgagtggaggcagtgccatctggcccgggtgcctgctcacgccgtggtggtccgggccgacacagatgggggcctcatcttccggctgctcaacgaaggccagcgtctgttcagccacgagggcagcagcttccagatgttcagctctgaggcctatggccagaaggatctactcttcaaagactctacctcggagcttgtgcccatcgccacacagacctatgaggcgtggctgggccatgagtacctgcacgccatgaagggtctgctctgtgaccccaaccggctgcccccctacctgcgctggtgtgtgctctccactcccgagatccagaagtgtggagacatggccgtggccttccgccggcagcggctcaagccagagatccagtgcgtgtcagccaagtccccccaacactgcatggagcggatccaggctgagcaggtcgacgctgtgaccctgagtggcgaggacatttacacggcggggaagacgtacggcctggttcccgcagccggggagcactatgccccggaagacagcagcaactcgtactacgtggtggccgtggtgagacgggacagctcccacgccttcaccttggatgagcttcggggcaagcgctcctgccacgccggtttcggcagccctgcaggctgggatgtccccgtgggtgcccttattcagagaggcttcatccggcccaaggactgtgacgtcctcacagcagtgagcgagttcttcaatgccagctgcgtgcccgtgaacaaccccaagaactacccctcctcgctgtgtgcactgtgcgtgggggacgagcagggccgcaacaagtgtgtgggcaacagccaggagcggtattacggctaccgcggcgccttcaggtgcctggtggagaatgcgggtgacgttgccttcgtcaggcacacaaccgtctttgacaacacaaacggccacaattccgagccctgggctgctgagctcaggtcagaggactatgaactgctgtgccccaacggggcccgagccgaggtgtcccagtttgcagcctgcaacctggcacagataccaccccacgccgtgatggtccggcccgacaccaacatcttcaccgtgtatggactgctggacaaggcccaggacctgtttggagacgaccacaataagaacgggttcaaaatgttcgactcctccaactatcatggccaagacctgcttttcaaggatgccaccgtccgggcggtgcctgtcggagagaaaaccacctaccgcggctggctggggctggactacgtggcggcgctggaagggatgtcgtctcagcagtgctcgggcgcagcggccccggcgcccggggcgcccctgctcccgctgctgctgcccgccctcgccgcccgcctgctcccgcccgccctctgagcccggccgccccgccccagagctccgatgcccgcccggggagtttccgcggcggcttcgcgctggaatccagaaggaagctcgcgaaggccgggcccggcgtgggcgggagcaggcgcctccccgggagccccgccgcccacgggcgccacctggcgctgctacctgaggcgccgcccccgggcccgcgcggcccttcccgccaaccgccgcctcccgccacctggagccgcgcgggccgcgccggaggaggccggttgcccaggaaaccgctgagtccgggcttcccgccgcccgccccgcggtgtcgcccgaggggcccgcccgcctcctccccgcagccccgcgcccccgtccgcgaggccccctggggacgcggtggccgccgaggcgcctacacccgcaggccgcggccaggccgtcccaggaggccccggcgccaacgggacccggcgcgtgggacagcggcctctgctggcggcggcgggagggaggccggaccggggcgacggggagaagccttcgcccgcgggaccgtgtccggggtgggggctccagttcctccgaccgcccgtgcgctgggagggaggccgagcccggggaacgccgcgtgccctgcctcgtcccccactgtggccgcgccagctccatcccgggccagccgcgtccacgggccccctcccgagtctcctcaggctctcgcctcccctacccccgtgggatgcccaccgcccgcacccacgcccgagcctggcggcagcagccgccccccgcctgaagggagccggaggtgacccaggccgcgggctcccgaggcccctgaagggctgcgcgtggggacccgccatgcttctgggttccgaacgggggtgagctccgtctcctcacccggccccgcacccgctgggcctggggacccctcactccccgtgcccgcccctccgcgaggcagcagaaagcgcccggccggggcctctctctactccatcttgccacagttgtctgagaagccagaaaaagtttccagaactggcagcccttaaaaaaaatgaagaggaagagaagaaatgggagcaggcagccctcgtcagcagaccgggagccgcgtgggcgcggagccatttgcattccggtctgcgggggctcggggatgctggtgacaggcccggttcccggtggctcgcccccacctgcgggcgtcgggaaggatcccttccatctctcagccgcagaggaggccctggcagcgccccggctgtagccatgcaaccccgaggagtcccgggcaccttcaccccaccgggaggggccacaaggacctgggcctcggccaccaagctttgtcccctctcgctgtggggggctagtgattctcctccgacctgacgattgcttggttttttcaaaagggagttttgtgcggtgagaagtgtgtttctgtgtggctaactctgggctagcgtgccgtggccattgaaggtgtggcctgcgtgggtgcagtgtaagtgacgctggattgtcaggtggcagcaggggacccctgctgtgtcagtgctaatgaaacatgttggttggtttctaaaataaagccaaacaagccagcacatgcagaggcttggaccctgatagaaa

SEQ ID NO: 2178 - DNA, 1650 bp, Homo sapiens
agggggagcagggaggaagcccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcaggggtgacagctctggggaaggggtgtgtgacaagagccccctggagagatactacgactacagcggggccttccggtgcctggcggaaggggcaggggacgtggcttttgtgaagcacagcacggtactggagaacacggatgaaagtccatcacgaaggcaaacatggaccagatctgaggaggaagaaggcgagtgccctgcacacgaggaagcacgtaggacgatgcgctctagtgctgggcaagcctggaaatgggctcccgttcacaggccccaggacgagtctgacaaaggagaatttggaaaacgggcaaagagtagggatatgttgggttaagaatcagctctttcaaacttggggttttttttgagatgggggtctcaccatgttgcccaggctggtctcaaacccccagcctcaactgatcctcgcatctcagcctcctgagtagctgggatgacaggcgtgcacctggcagctttttcaaagtgttgatggtaatctgaggcaatctaagggagtcattttttaagtgactttatacagaaagattggtaagagccaaggggtagaagtggcataaatgtctaaagcagggaagtgacaggactttcattgttcttggctgaggagaagcgggagtggctgatggaagcacctaaatgatgcctttgtctgtgggaaggcaaatgatgccccagagctctaaccaaaggttttgcagccgccgaaaaacaggaaagttgggaagcgggggtaggactacactgaatcattaacagtgctgtaaactaccatgtggccattaacaatgacctttagggagttttcctaaacgatcactctggtgcgggtgtttggttttgttttaaaatagctttgcagtgaaagctttcatgaccatacaaattatcttttttcttcctatttccttgtagaggtttttttcctccttgtcttaaggtcataaaaatattgttatgtggga

SEQ ID NO: 2179 - DNA, 2018 bp, Homo sapiens
gcatgttgacacatcaggcccagctctatcactggggagggagataggctgccagggacagaaagggctctttgagaaggccactctgcctggagtgggggcgccgggcactgtcccccaaggtcgcggcagaggagataggggtctgtcctgcacaaacaccccaccttccactcggctcacttaaggcaggcagcccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcagcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaagtgacctgggagccaacaccctcgctgaggttccaggagcccccgcctggaggagctggccccccagagctggcgctgctggtgctgtaccctgggcctggccctgaggtcactgtgacgagggctgggctgccgggtgcccagagcctctgcccctcccgagacacccgctacctggtgttagcggtggaccgccctgcgggggcctggcgcggctccgggctggccttgaccctgcagccccgcggagaggactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggtccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggc

SEQ ID NO: 2180 - DNA, 1437 bp, Homo sapiens
atgctagggtctttggggctttgggcattacttcccacagctgtggaagcacccccaaacaggcgaacctgtgtgttctttgaggcccctggagtgcggggaagcacaaagacactgggagagctgctagatacaggcacagagctccccagagctatccgctgcctctacagccgctgctgctttgggatctggaacctgacccaagaccgggcacaggtggaaatgcaaggatgccgagacagtgatgagccaggctgtgagtccctccactgtgacccaagtccccgagcccaccccagccctggctccactctcttcacctgctcctgtggcactgacttctgcaatgccaattacagccatctgcctcctccagggagccctgggactcctggctcccagggtccccaggctgccccaggtgagtccatctggatggcactggtgctgctggggctgttcctcctcctcctgctgctgctgggcagcatcatcttggccctgctacagcgaaagaactacagagtgcgaggtgagccagtgccagagccaaggccagactcaggcagggactggagtgtggagctgcaggagctgcctgagctgtgtttctcccaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaa

SEQ ID NO: 2181 - DNA, 1787 bp, Homo sapiens
aagatttggccaggggcagctgtgctggcttatgctcttctccttctgctgctgccatcctccagcaagatgctagggtctttggggctttgggcattacttcccacagctgtggaagcacccccaaacaggcgaacctgtgtgttctttgaggcccctggagtgcggggaagcacaaagacactgggagagctgctagatacaggcacagagctccccagagctatccgctgcctctacagccgctgctgctttgggatctggaacctgacccaagaccgggcacaggtggaaatgcaaggatgccgagacagtgatgagccaggctgtgagtccctccactgtgacccaagtccccgagcccaccccagccctggctccactctcttcacctgctcctgtggcactgacttctgcaatgccaattacagccatctgcctcctccagggagccctgggactcctggctcccagggtccccaggctgccccaggtgagtccatctggatggcactggtgctgctggggctgttcctcctcctcctgctgctgctgggcagcatcatcttggccctgctacagcgaaagaactacagagtgcgaggtgagccagtgccagagccaaggccagactcaggcagggactggagtgtggagctgcaggagctgcctgagctgtgtttctcccaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagctggcacccagaggtacatggcaccagagctcttggacaagactctggacctacaggattggggcatggccctccgacgagctgatatttactctttggctctgctcctgtgggagatactgagccgctgcccagatttgaggcctgcagtccaccacccttccaactggcctatgaggcagaactgggcaatacccctacctctgatgagctatgggccttggcagtgcaggagaggaggcgtccctacatcccatccacctggcgctgctttgccacagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaa

SEQ ID NO: 2182 - DNA, 1863 bp, Homo sapiens
gtatctgaagaaagatttggccaggggcagctgtgctggcttatgctcttctccttctgctgctgccatcctccagcaagatgctagggtctttggggctttgggcattacttcccacagctgtggaagcacccccaaacaggcgaacctgtgtgttctttgaggcccctggagtgcggggaagcacaaagacactgggagagctgctagatacaggcacagagctccccagagctatccgctgcctctacagccgctgctgctttgggatctggaacctgacccaagaccgggcacaggtggaaatgcaaggatgccgagacagtgatgagccaggctgtgagtccctccactgtgacccaagtccccgagcccaccccagccctggctccactctcttcacctgctcctgtggcactgacttctgcaatgccaattacagccatctgcctcctccagggagccctgggactcctggctcccagggtccccaggctgccccaggtgagtccatctggatggcactggtgctgctggggctgttcctcctcctcctgctgctgctgggcagcatcatcttggccctgctacagcgaaagaactacagagtgcgaggtgagccagtgccagagccaaggccagactcaggcagggactggagtgtggagctgcaggagctgcctgagctgtgtttctcccaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagctggcacccagaggtacatggcaccagagctcttggacaagactctggacctacaggattggggcatggccctccgacgagctgatatttactctttggctctgctcctgtgggagatactgagccgctgcccagatttgaggcctgacagcagtccaccacccttccaactggcctatgaggcagaactgggcaatacccctacctctgatgagctatgggccttggcagtgcaggagaggaggcgtccctacatcccatccacctggcgctgctttgccacagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaaatatgcagtttatgtgtcatcaatgtacatgccaacataaatatggcgattgtatagctgt

SEQ ID NO: 2183 - DNA, 4721 bp, Homo sapiens
atcaccgagggcgggcgcctcagcccgggaggacactccccagggtaaactacaggcctcacaaagcggagggagctggacgcgaaggctcggcagcggcgccgacaggcttaccccaggcccactctaggccgcacagggttcgcgccacctccggcccaggacagctctcagacgctgccagcgtggagctcgacccggctcacaatgcgctgggccccgcagcgtgagcgcaggcgcccgagaggcggcgggggtcgggcggacggcgcgctccagccgagccgcctccctctctcggcccacacccgcgcggccgcccttcgcctgccggggagctgcgggtggctggagggcgggaagcgaccggccagtctgcacctgcatgacccggtcgcgcgccgacccctcccctctctctcccgggctcagtcctccttcctcttccgtccccctcccttttctccgggctgcaaccgggttccgccccgctcgcgcggctgcccggccagctgtgatgtcaccaggccacgccccctaatataaatactggcgtcgctggcgccgccttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctca

SEQ ID NO: 2184 - DNA, 2857 bp, Homo sapiens
aaatactggcgtcgctggcgccgccttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccatggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcat

SEQ ID NO: 2185 - DNA, 773 bp, Homo sapiens
cttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacgagttctttcctcatcatccataaatgtcattcattgagcatgtgatcagcttctcctagatagatgaaacattttgcctccaccaggagtgccttgatcctggtgagatacactttagggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacatacc

SEQ ID NO: 2186 - DNA, 660 bp, Homo sapiens
acacatggaggttcctggagagtggcgggcccagggagggcatggaggtttcacatccctccccctgtatcttgccctatgtgtctcttcatctgtatccttcgcaatatcctttataataaaccagtaaacacagggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggcttta

SEQ ID NO: 2187 - DNA, 1012 bp, Homo sapiens
gcgcgcaaagccgtgcggagattggaggccgcgcgggtccctggtctgggccatgtctggctgtgatgctcgggagggagactgttgttcccggagatgcggcgcgcagtggcttacatggctatcaaaattgaagttcaaggtcaccagagttttgcaataccttcaggaacattctggctttggcgctcacttctctcccaggacaaggagcatccaagatacctgatcccagaactttgcaaacagttttaccatttaggctgggtcactgggactggaggaggaattagcttgaagcatggcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacacttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtccctcccacaacacggaattatgggagctacaagatgagatttgagtggggacacagagccaaaccatatcatccagcgtccaggaagattca

SEQ ID NO: 2188 - DNA, 1366 bp, Homo sapiens
acgttggccttgcctcccgggaagtcaggtgcgccgctggatatctcagccggcggggccttaccagaccccggcccccgccccgttcgccccgcccccgggctgccctcagcgccgcctgattgcatttgcggcctcgctgccgtatcccaggctaagcgccgcgcgcaaagccgtgcggagattggaggccgcgcgggtccctggtctgggccatgtctggctgtgatgctcgggagggagactgttgttcccggagatgcggcgcgcaggacaaggagcatccaagatacctgatcccagaactttgcaaacagttttaccatttaggctgggtcactgggactggaggaggaattagcttgaagcatggcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacacttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaatttcctcattgtggaatgagcattctcttgttttaatgttggtgtcagaaaataaatatgaaacattaagtccaaa

SEQ ID NO: 2189 - DNA, 3220 bp, Homo sapiens
gagcattctctctggcagccggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccacccccggcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccaggtctcccatctcctactttatgacgccctcttccctcttgatgatgtcttttcaaagcaaatgaagtgccttttcccgaggctggggctgggggtggctgggaggggaagggaagggagaggcaagctggctgtgaactgtcctgttgtggggctggagctgctcccacctccctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgacagttcgcccttactcttggaggtcatgttcaggaggggcattcctttcccctgggggtcatgggtgtccccatgcccacatattgcacgtgcagggaggtaagtgcctgcatcccaaatcggttctaggtcaactggcctcaaactgatttgccatgagctcacaaaatgaatccctatgcttaatgaccaggtcacataaaatccagcccacttacaggttttctggcatctgtttgggtgtcctaatttttttggcagtgtcatttgaagaatttttttaaagcagtttatttaagaacatactgattaaatgcaggatcgctactaaaaattgttttgtatccttggtgggtgtcttctgctattttatctacttttgaacactttcaggactttttagccagtttgcctttcttgaaaaatgttatgttttcagcaataaatacatttgataatgactttgtttgtatcattttatgtttcacaaagtagagttgcttgatgaatgagatagcctgaaaaataaaatgcaaagagttcaat

SEQ ID NO: 2190 - DNA, 387 bp, Homo sapiens
atgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccacccccggcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactga

SEQ ID NO: 2191 - DNA, 2655 bp, Homo sapiens
cggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccacccccggcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccaggtctcccatctcctactttatgacgccctcttccctcttgatgatgtcttttcaaagcaaatgaagtgccttttcccgaggctggggctgggggtggctgggaggggaagggaagggagaggcaagctggctgtgaactgtcctgttgtggggctggagctgctcccacctccctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctga

SEQ ID NO: 2192 - DNA, 474 bp, Homo sapiens
aggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 2193 - DNA, 1470 bp, Homo sapiens
tcagttcccactgcagcgcaggtgagctctcctgaggacctctctgtcagctcccctgattgtagggaggatccagtgtggcaagaaactcctccagcccagcaagcagctcaggatgttcctgaaggccgtggtcctgaccctggccctggtggctgtcgccggagccagggctgaggtcagtgctgaccaggtggccacggtgatgtgggactacttcagccagctgagcaacaatgccaaggaggccgtggaacatctccagaaatctgaactcacccagcaactcaatgccctcttccaggacaaacttggagaagtgaacacttacgcaggtgacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcagcacgcaggccgagcagctgcggcgccagctgaccccctacgcacagcgcatggagagagtgctgcgggagaacgccgacagcctgcaggcctcgctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccgaggagctcaaggccaggatctcggccagtgccgaggagctgcggcagaggctggcgcccttggccgaggacgtgcgtggcaacctgaggggcaacaccgaggggctgcagaagtcactggcagagctgggtgggcacctggaccagcaggtggaggagttccgacgccgggtggagccctacggggaaaacttcaacaaagccctggtgcagcagatggaacagctcaggcagaaactgggcccccatgcgggggacgtggaaggccacttgagcttcctggagaaggacctgagggacaaggtcaactccttcttcagcaccttcaaggagaaagagagccaggacaagactctctccctccctgagctggagcaacagcaggaacagcagcaggagcagcagcaggagcaggtgcagatgctggcccctttggagagctgagctgcccctggtgcactggccccaccctcgtggacacctgccctgccctgccacctgtctgtctgtctgtcccaaagaagttctggtatgaacttgaggacacatgtccagtgggaggtgagaccacctctcaatattcaataaagctgctgagaatctagcct

SEQ ID NO: 2194 - DNA, 1897 bp, Homo sapiens
caggcctccctccacctgtcttctcagagcaggtaatggcaagcatggctgccgtgctcacctgggctctggctcttctttcagcgttttcggccacccaggcacggaaaggcttctgggactacttcagccagaccagcggggacaaaggcagggtggagcagatccatcagcagaagatggctcgcgagcccgcgaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcacatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgatagaa

SEQ ID NO: 2195 - DNA, 526 bp, Homo sapiens
aatgtctgctctctgtgcccagacgtgagcagagcaggtaatggcaagcatggctgccgtgctcacctgggctctggctcttctttcagcgttttcggccacccaggcacggaaaggcttctgggactacttcagccagaccagcggggacaaaggcagggtggagcagatccatcagcagaagatggctcgcgagcccgcgaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttg

SEQ ID NO: 2196 - DNA, 1929 bp, Homo sapiens
ataaagcagaatgtctgctctctgtgcccagacgtgagcaggcctccctccacctgtcttctcagagcaggtaatggcaagcatggctgccgtgctcacctgggctctggctcttctttcagcgttttcggccacccaggcacggaaaggcttctgggactacttcagccagaccagcggggacaaaggcagggtggagcagatccatcagcagaagatggctcgcgagcccgcgaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcacatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatg

SEQ ID NO: 2197 - DNA, 1282 bp, Homo sapiens
actttaaggagggctgtccaactgcaaggacgctgtaagcaggaagtgaaaccacagagcttcaaaaaaagagcgggacagggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaagaatttgcatactgctgggaaaactttgtgtacaatgaaggtcagcaattcatgccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctc

SEQ ID NO: 2198 - DNA, 616 bp, Homo sapiens
ggaggtcactttagggagggctgtcctgaaacctggagcctggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccgtttggacgcaaagatctttcgaggccaggtgcccaggtctttcatcagagccccatttcaagtgctcagtagcccctttggccagtgcgccccaccacatgggacagcgcaggtccagtggcctccccagctgaccgcaggcagggaacaaggcagaccctagagggccaggccacagcaggggctgaggatgcctggtgaatggatgcctgggagaatggatgccagaattcacgcatgaggctctgaacagggctgggaaaacttccaaacgaagggaagctcatgtcttggtgcactttgtgatgatgcttcaacagcaggactgagatggggacatttacaataaacagaaatgtatgggctcga

SEQ ID NO: 2199 - DNA, 879 bp, Homo sapiens
gaagtccagagacagagcaccatgacttctgagaaaggtccttcaaccggtgaccccactctgaggagaagaatcgaaccctgggagtttgacgtcttctatgaccccagagaacttcgtaaagaggcctgtctgctctacgaaatcaagtggggcatgagccggaagatctggcgaagctcaggcaaaaacaccaccaatcacgtggaagttaattttataaaaaaatttacgtcagaaagagattttcacccatccatgagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcagagtattatcactgctggaggaattttgtcaactacccacctggggatgaagctcactggccacaatacccacctctgtggatgatgttgtacgcactggagctgcactgcataattctaagtcttccaccctgtttaaagatttcaagaagatggcaaaatcatcttacatttttcagacttcatcttcaaaactgccattaccaaacgattccgccacacatccttttagctacagggctgatacatccttctgtggcttggagatgaataggatgattccgtgtgtgtactgattcaagaacaagcaatgatgacccactaaagagtgaatgccatttagaatctagaaatgttcacaaggtaccccaaaactctgtagcttaaaccaacaataaatatgtattacctctggca

SEQ ID NO: 2200 - DNA, 1151 bp, Homo sapiens
gcctctctcctctccctcagtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacaggagaacggctgcctgccaacttctttaaattccagttccggaatgtggagtacagttccgggaggaacaagaccttcctctgctatgtggttgaagcacagggcaaggggggccaagtgcaggcatctcggggatacctagaggatgagcatgcggctgcccatgcagaggaagctttcttcaacaccatcctgccagccttcgacccagccctgcggtacaatgtcacctggtatgtgtcctccagcccctgtgcagcgtgtgctgaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtg

SEQ ID NO: 2201 - DNA, 1242 bp, Homo sapiens
agtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacaggagaacggctgcctgccaacttctttaaattccagttccggaatgtggagtacagttccgggaggaagctttcttcaacaccatcctgccagccttcgacccagccctgcggtacaatgtcacctggtatgtgtcctccagcccctgtgcagcgtgtgctgaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgtttttcccgtggccagatttttaagaaacttgaacatctggaagttgccacagacaagcgagctagtccagacacagggacactccaggctatgaaccaagccatggttaaaccaagacttgcctagacaatgcagaataactctcccatacagacttcttacgacaatcaagtgagggcctttcccttctctgaaggcaagtaatagggcagaa

SEQ ID NO: 2202 - DNA, 1444 bp, Homo sapiens
ggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggcataagacctacctgtgctacgaagtggagcgcctggacaatggcacctcggtcaagatggaccagcacaggggctttctacacaaccaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatgaatttaagcactgctgggacacctttgtggaccaccagggatgtcccttccagccctgggatggactagatgagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacact

SEQ ID NO: 2203 - DNA, 1478 bp, Homo sapiens
ggcctccctgccacggggatgctgccttttctgctccgggtgtttccacgaggcaggcatggaatcttccctggacaagcgacataccgtggagagacaggctcctgaatcctaagagaatgttggtgaagatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggcataagacctacctgtgctacgaagtggagcgcctggacaatggcacctcggtcaagatggaccagcacaggggctttctacacaaccaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatgaatttaagcactgctgggacacctttgtggaccaccagggatgtcccttccagccctgggatggactagatgagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacact

SEQ ID NO: 2204 - DNA, 1533 bp, Homo sapiens
caaaaaaagagcgggacagggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaagaatttgcatactgctgggaaaactttgtgtacaatgaaggtcagcaattcatgccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacactagcaaa

SEQ ID NO: 2205 - DNA, 1309 bp, Homo sapiens
agataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaaaaaaaaaaaaaaaaaaaaaaaaa

SEQ ID NO: 2206 - DNA, 2694 bp, Homo sapiens
gtgctctgctggctcagcctggtgtggacccacctcgcgggcgctggctgcaatgactttctctttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagggggaggggccatgactacgaggccctgggaggtcactttagggagggctgtcctgaaacctggagcctggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccgtttggacgcaaagatctttcgaggccaggtgtattcccagcctgagcaccacgcagaaatgtgcttcctctcttggttctgtggcaaccagctgcctgcttacaagtgtttccagatcacctggtttgtatcctggaccccctgcccggactgtgtggcgaagctggccgaattcctggctgagcaccccaatgtcaccctgaccatctccgccgcccgcctctactactactgggaaagagattaccgaagggcgctctgcaggctgagtcaggcaggggcccgcgtgaagattatggacgatgaagaatttgcatactgctgggaaaactttgtgtacagtgaaggtcagccattcatgccttggtacaaattcgatgacaattatgcattcctgcaccgcacgctaaaggagattctcagaaacccgatggaggcaatgtatccacacatattctacttccactttaaaaacctacgcaaagcctatggtcggaacgaaagctggctgtgcttcaccatggaagttgtaaagcaccactcacctgtctcctggaagaggggcgtcttccgaaaccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctactacttctgggatacagattaccaggaggggctccgcagcctgagtcaggaaggggcctccgtggagatcatgggctacaaagattttaaatattgttgggaaaactttgtgtacaatgatgatgagccattcaagccttggaaaggactaaaatacaactttctattcctggacagcaagctgcaggagattctcgagtgaggggtctccccgggcctcatggtctgtctcctctagcctcctgctcatgttgtgcaggcctcccctccatcctggaccagctgtgcttttgcctggtcatcctgagcccctcctggcctcagggccattccatagtgctcccctgcctcaccacctcctctccgctctcccaggctcttcctgcagaggcctctttctgcctccatggctatccatccacccaccaagaccctgttccctgagcctgcatgcccctaacctgccttttcccatctccccagcataacctaatattttttttttttttttgagacggaatttcgctctgtcacccagactggagtgcaatggcttgatcttggctcactgcaaactctgcctaccaggttcaagcgattctcctgcctccgcctcccgagtagctggaattacagacgcctgccaccacgcacagctaactttttttttttttgtatttttagtagtgactgggtttcaccatgttggccaggctggtcttgaactcctgacctcaggtgatccgcctatctcagcctcccaaagtgctgggattacaggcgtgagccactggcccggcggcacaaccaaatcttattaaactcaccctaggctggccgcggtgactcatgcctataatcccccagcaatttgggaggcagaggtgagagaatcgcttgagcccaggaattcgagaccagcctgggccacatgacaaagccccatctctacaaaaaaattacaaaaaaaaaaaaaacaggtgtggtggcatgcacctgtagttgaagctacttggaaggatgaagtgggaggattgcttgagccggggaggtggaggctgcagtgaactgagatcacgtcactgaactccagtctgagcaacagatcgagaccctgcctgaaaataaatcaataaataaactcaaccgaaatgggtatgaaagttgaaatgggtatgtaagttgaaaaccagaagttttgagaaacatcctttgttaactttcatcctacaaattgggtcattcatgtcctacgcagctaaaacagagcccaggagccagggaggaaaagcagtcaggccacacaccattgctcccaaaatggacttctctgcaagcctgactcctgaaactgtgcattgtaccctgaaaccagctttatccatagcttctgcaataaatggctgtaagtcttgga

SEQ ID NO: 2207 - DNA, 1834 bp, Homo sapiens
gtgctctgctggctcagcctggtgtggacccacctcccgggcgctggctgcaatgactttctctttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatactaaatctttctgta

SEQ ID NO: 2208 - DNA, 1506 bp, Homo sapiens
gtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatact

SEQ ID NO: 2209 - DNA, 1046 bp, Homo sapiens
tgacttttgggagagctgaccttttgtgacttttgggagagctgccaaaagtgaaacttagtgcctcagacaagcaggggcaagtctgctaaggaagctgtggccagaagcacagatcagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccaaagtttgctgactgctgggaaaactttgtggaccacgagaaaccgctttccttcaacccctataagatgttagaggagctagataaaaacagtcgagccataaagcgacggcttgagaggataaagtcctgaagtgtggatgttttagagaatgacttaagaagtttgcagcttggacccgtatcccactcattatcaagaagcaactcaagatgactttccctggggcatgtcagttgcctcatagcctgctggtcctgtaagcaagcactaagctccacagtgccagttccttgccccaacctggccccatccaagtacagaagaccttcctttcctcctttttccatattgctttctgttctaagtgggtgaataattttataattgaaaaaataaagataaagtctgtaaatccagccgggtacggtggctcacgcctgtaatcctagcactttgggaggctgagatgctcggccaataaatttctattgtttatgaa

SEQ ID NO: 2210 - DNA, 1023 bp, Homo sapiens
tgaaacttagtgcctcagacaagcaggggcaagtctgctaaggaagctgtggccagaagcacagatcagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccaaagtttgctgactgctgggaaaactttgtggaccacgagaaaccgctttccttcaacccctataagatgttagaggagctagataaaaacagtcgagccataaagcgacggcttgagaggataaagattccaggggtacgtgcgcagggtcgttacatggatatattgtgtgatgctgaggtctgagtcacccaatctactggaacatagcacccaatagcagtcctgaagtgtggatgttttagagaatgacttaagaagtttgcagcttggacccgtatcccactcattatcaagaagcaactcaagatgactttccctggggcatgtcagttgcctcatagcctgctggtcctgtaagcaagcactaagctccacagtgccagttccttgccccaacctggccccatccaagtacagaagaccttcctttcctcctttttccatattgctttctgttctaagtgggtgaataattttataattgaaaaaataaagataaagtctgtaaatccagccgggtacggtgg

SEQ ID NO: 2211 - DNA, 639 bp, Homo sapiens
tgacttttgggagagctgaccttttgtgacttttgggagagctgccaaaagtgaaacttagtgcctcagacaagcaggggcaagtctgctaaggaagctgtggccagaagcacagatcagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccaaattccaggggtacgtgcgcagggtcgttacatggatatattgtgtgatgctgaggtctgagtcacccaatctactggaacatagcacccaatag

SEQ ID NO: 2212 - DNA, 1047 bp, Homo sapiens
tgacttttgggagagctgaccttttgtgacttttgggagagctgccaaaagtgaaacttagtgcctcagacaagcaggggcaagtctgctaaggaagctgtggccagaagcacagatcagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccaaagtttgctgactgctgggaaaactttgtggaccacgagaaaccgctttccttcaacccctataagatgttagaggagctagataaaaacagtcgagccataaagcgacggcttgagaggataaagcagtcctgaagtgtggatgttttagagaatgacttaagaagtttgcagcttggacccgtatcccactcattatcaagaagcaactcaagatgactttccctggggcatgtcagttgcctcatagcctgctggtcctgtaagcaagcactaagctccacagtgccagttccttgccccaacctggccccatccaagtacagaagaccttcctttcctcctttttccatattgctttctgttctaagtgggtgaataattttataattgaaaaaataaagataaagtctgtaaatccagccgggtacggtggctcacgcctgtaatcctagcactttgggaggctgagatgctcggccaataaatttctattgtttatg

SEQ ID NO: 2213 - DNA, 2648 bp, Homo sapiens
agtgttcttagaggtagccacacctcagcaagggctttctaacttggaacagcaaagttcaaatgaacgaatagacacaaactgtgaaagagtcctgaacccattacaaggtgaatctttacagcacaattgccttctgaagctacttgaaacagggcatgggacttaaaggagaaaaaaaaggaaatggaccatctcttctaacacctggaatgtgatccaagcctggagacaaattgatggtttgcagctagaagacagtaaatctagcaatggagcccatatatgaggagtacctagcaaatcatggaacaatagtaaaaccatattactggctaagcttctctctcgattgctctaattgtccttaccatattcgaacaggtgaagaagcaagagtttccctcacagaattttgtcagatttttggattcccttatgggacaacatttcctcaaacaaaacacctcacattttatgaactaaaaacttcttctggtagcctggtgcaaaagggccatgctagcagttgcactgggaattatatccatccagaatcaatgctctttgaaatgaatggttatcttgactcagccatatacaataatgacagcatcaggcatatcattctgtattccaacaactccccttgtaatgaagctaaccactgctgcatcagcaaaatgtataatttcctgattacgtatccaggcatcactcttagtatttatttttctcagctctatcatactgagatggactttcctgcctcagcatggaaccgcgaagctctccggagcctggccagcttatggccgcgggttgttttgagtccaataagtggtgggatctggcattctgttctccacagctttataagtggtgtctcaggatcacatgtttttcagcccattttaactgggagagcactggctgacaggcacaacgcatatgaaatcaatgccataacaggcgtaaaaccttacttcactgatgttcttctccagacaaaaaggaatccaaacacaaaagctcaggaggctttagagagctaccccttaaacaatgcctttcctggacagttttttcaaatgccgagtggacaactccaacccaacctacctccagacctcagggctcctgttgtttttgtgctagtgcctctcagggacttaccaccaatgcatatgggccaaaacccaaataaacccaggaatatcgtaaggcacttaaatatgcctcaaatgtcattccaggaaaccaaggaccttggaaggcttcccactggaaggtcagtggagatagtggaaatcacagaacagtttgcaagtagcaaggaggcagatgaaaagaagaagaagaaagggaagaaataaaatctacattcctacagcatgaaaccaattaccaagggacttattagataggcaataaaaatctggaaactttctctctcagggctgagccaagatggagataaactgatgcactaaaagcaaaccttgaattatttaccatatcaactattataaagttacactattttaaacataatccaaaatgtttccataagcaacttgatctctctcctttattttgaaagtggcagtatcaaaatggaaccattagcagcttgctaatattttgatgcagaaaaggaatctcattattctattttactcacatcatctttccactacaaaagcccatggacaaaatagctacctaaatttgtttcggtaaaaaatttactgtaaaattgaaaaacagcctgaagctactgacattaagtgctgtttgcaggagcaaaccagtgattttctattaattgttaatcatggacagaagattttaggcagctcatttttttctaaagtgattcaaaatagttttgtgtgggaaaaagctcttctgctgattacatatagctataaagattaaaacctagccacctgctcagtttgatcttccccagctcagacctctcccttctgagcagatgatagaggtaagatgatacatgagaacctccaatggctcctgtcatcacatactgtataaaatccaagttcctcttactggctttcaaggatcctcctttaacttcctgttgccttgtctcatcagcaagatcataagtacctacaggtcaagcactgtctctcccttctctttagcttttcccttaggatctagcacattacccagcaaaatgtgagtagcaaggctgaaatgacatctcaataacttcaccaatgattgtaactcagcatcccttctccatcccagctgaaagcctgcttcaccatcctgcaagagatgttttttctttttgttagcatccattcccctttctaatgcagctcccaatgcataatgtgtgttttacttccctctttctgactccatcctcgtcaccagtgaatatttgtaccttctcttaaaatcttcaaaacacacttctaggaagtgctccttgattaatcctctaagcacttaaatgaaagcactttgcttatgcttatttcacatttgctgccacttgcctctttgaaatatgtaaagatacattacaagaaaaatgtacattttctcgtaacttgctattaatttttttctttatatatatatataaagtaatcctaagc

SEQ ID NO: 2214 - DNA, 461 bp, Homo sapiens
ctccccagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaattc

SEQ ID NO: 2215 - DNA, 717 bp, Homo sapiens
gttgtggctgtggagcggaagtgggtctcaaccactataaatcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaagggccaagatggaggggctgactcagtccagccaacatttaatgagcacctactttatgtatggagctctaacccatgggtccatgggaataaagcagtgaatagtaacaataaataatcgt

SEQ ID NO: 2216 - DNA, 1829 bp, Homo sapiens
gagttgagcacagagggacagaggcacggaacccccagaaatgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaggatgatggcttgagcccaggagttcgagaccagcctgggcaacacagcgagatctcttgggggtaaaacaaaaagaaaaaaaaaagttcatacttctccaataaataaagtctcacctgtgtccctgtctggatccttccccagtgtggccagaaaaaaacccaccccactgcctcccaggaatcaatgagtagaagaggtgacacctgatggggaaggaagagtagggaggtcgggaagggtatcaaggaataacaccctattgtgggcttgcggagaatgggggacttcaaggcgtgtcagtttcaggagggtgagggcaggagcgtgggtggagtcagcaggtccccatgatggccctcactgagagcttcgcccttgtctcctacaagctctgactccattcccagtgggcacccagcacctccaacccctccacagcccccaacccagcctctgtcggaggcgaattctcagagtgagggttccctgtcacttgagagaaggttccctgtgacgtgaccttgggggacgtcattgccctttctgtccccacccaccccctccgcagttctgttggccaggactttggcctagacaaaggatgggggttgtggctgtggagcggaagtgggtctcaaccactataaatcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaagggccaagatggaggggctgactcagtccagccaacatttaatgagcacctactttatgtatggagctctaacccatgggtccatgggaataaagcagtgaatagtaacaataaataatcgtaacagcaa

SEQ ID NO: 2217 - DNA, 550 bp, Homo sapiens
aaccctcctgcctgtctgctcagttcatccctagaggcagctgctccaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 2218 - DNA, 604 bp, Homo sapiens
ttcatccctagaggcagctgctccaggggccacgccacctccccagggaggggtccagaggcatggggacctggggtgcccctcacaggacacttccttgcaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 2219 - DNA, 359 bp, Homo sapiens
ggctgcagggctggcgggacagcagcgtggactcagtctcctagggatttcccaactctcccgcccgcttgctgcatctggacaccctgcctcaggccctcatctccactggtcagcaggtgacctttgcccagcgccctgggtcctcagtgcctgctgccctggagatgatataaaacaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtg

SEQ ID NO: 2220 - DNA, 1761 bp, Homo sapiens
gagttgagcacagagggacagaggcacggaacccccagaaatgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaaaacaaaaagaaaaaaaaaagttcatacttctccaataaataaagtctcacctgtgtccctgtctggatccttccccagtgtggccagaaaaaaacccaccccactgcctcccaggaatcaatgagtagaagaggtgacacctgatggggaaggaagagtagggaggtcgggaagggtatcaaggaataacaccctattgtgggcttgcggagaatgggggacttcaaggcgtgtcagtttcaggagggtgagggcaggagcgtgggtggagtcagcaggtccccatgatggccctcactgagagcttcgcccttgtctcctacaagctctgactccattcccagtgggcacccagcacctccaacccctccacagcccccaacccagcctctgtcggaggcgaattctcagagtgagggttccctgtcacttgagagaaggttccctgtgacgtgaccttgggggacgtcattgccctttctgtccccacccaccccctccgcagttctgttggccaggactttggcctagacaaaggatgggggttgtggctgtggagcggaagtgggtctcaaccactataaatcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaagggccaagatggaggggctgactcagtccagccaacatttaatgagcacctactttatgtatggagctctaacccatgggtccatgggaataaagcagtgaatagtaacaataaataatcgtaacagc

SEQ ID NO: 2221 - DNA, 613 bp, Homo sapiens
gagttgagcacagagggacagaggcacggaacccccagaaatgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaggatgatggcttgagcccaggagttcgagaccagcctgggcaacacagcgagatctcttgggggtaaaacaaaaagaaaaaaaaaagttcatacttctccaataaataaagtctcacctg

SEQ ID NO: 2222 - DNA, 1130 bp, Homo sapiens
tctctctcgcacacatacccacacacacacacacacacacacacgcgcgcgcgaaaacaatatctcatttcttcttcagggagcagctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccccccccataaagacaaaccaatcaaccacgacaaaggaagttgacctgaacatgtaaccatgccctaccctgttaccttgctagctgcaaaataaacttgttgctgacctgctgtgctcgcagtagattccaagtt

SEQ ID NO: 2223 - DNA, 681 bp, Homo sapiens
aagacaggcatctcaaatcggctgattctgcatctggaaactgccttcatcttgaaagaaaagtttaccaggaagtaacccgggcaaattcacctcgttggtatgaagagagtgtcagcagaggtcgcctccagaggaggtgctgtggagactgagcgcatagcacccttaaaatcctgggaccagggcttctccacggctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttgg

SEQ ID NO: 2224 - DNA, 1263 bp, Homo sapiens
cctcgtgactgggggctggcccagcccgccctatccctgggggagggggcgggacagggggagccctataattggacaagtctgggatccttgagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgca

SEQ ID NO: 2225 - DNA, 923 bp, Homo sapiens
ccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagc

SEQ ID NO: 2226 - DNA, 864 bp, Homo sapiens
gaggtgaaggacgtccttccccaggagccggtgagaagcgcagtcgggggcacggggatgagctcaggggcctctagaaagagctgggaccctgggaacccctggcctccagactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacc

SEQ ID NO: 2227 - DNA, 737 bp, Homo sapiens
gagtcctactcagccccagcggaggtgaaggacgtccttccccaggagccgtttctccttccccagactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctg

SEQ ID NO: 2228 - DNA, 1200 bp, Homo sapiens
ggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacacaaaatgtcacacttgtttcttgttcatccaaggaacctaattgaaatttaaaaataaagctactgaatttattgccgcaccc

SEQ ID NO: 2229 - DNA, 4640 bp, Homo sapiens
cgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaagggaatggagaggccggcggcccgggagccgcatgggcccgacgcgctgcggcgcttccagggactgctgctggaccgccgaggccggctgcacggccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactctttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcgtttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactgcaacaaatgctaacttctaatccccttgatgagctttcacgaagtctcacggcttctctagggactccatggtcttcagagtcgttcacagatgaccaaggacagactgtgtcccagaagccaaaatgagagagagagagagagagcacgcgtacgtgcaccctggggcagtgtctcaccgtatgaacaagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatcgcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaa

SEQ ID NO: 2230 - DNA, 4646 bp, Homo sapiens
gcagccattggttctctggaactataaagcacactcatccagaaacagcctcagattttactttcctggaggcagacagaagtgaatgggaatggagaggccggcggcccgggagccgcatgggcccgacgcgctgcggcgcttccagggactgctgctggaccgccgaggccggctgcacggccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactctttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcgtttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactgcaacaaatgctaacttctaatccccttgatgagctttcacgaagtctcacggcttctctagggactccatggtcttcagagtcgttcacagatgaccaaggacagactgtgtcccagaagccaaaatgagagagagagagagagagcacgcgtacgtgcaccctggggcagtgtctcaccgtatgaacaagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatcgcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaaa

SEQ ID NO: 2231 - DNA, 3000 bp, Homo sapiens
actttccctttcgaattcctcggtatatcttggggactggaggacctgtctggttattatacagacgcataactggaggtgggatccacacagctcagaacagctggatcttgctcagtctctgccaggggaagattccttgacttctggggtgatggagaagaaacaggctgtgctgtgtccctaatgggaaacgtggctgagacaggggagtgagaagggtgcgttgcagaatggtgcctgtggcatgatgccagctttgcaatcatgagattcaaaagccacactgtggaattgaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactca

SEQ ID NO: 2232 - DNA, 1223 bp, Homo sapiens
tatacagacgcataactggaggtgggatccacacagctcagaacagctggatcttgctcagtctctgccaggggaagattccttgagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcag

SEQ ID NO: 2233 - DNA, 2918 bp, Homo sapiens
tggactgaaggtggaggggagcgtgtttgctgtgcttggtcatgagctgctgggaagttgtgactttcactttccctttcgaattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 2234 - DNA, 1564 bp, Homo sapiens
gacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtc

SEQ ID NO: 2235 - DNA, 2040 bp, Homo sapiens
ctggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaacttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgt

SEQ ID NO: 2236 - DNA, 2901 bp, Homo sapiens
gactttcactttccctttcgaattcctcggtatatcttggggactggaggacctgtctggttattatacagacgcataactggaggtgggatccacacagctcagaacagctggatcttgctcagtctctgccaggggaagattccttggaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctgg

SEQ ID NO: 2237 - DNA, 2808 bp, Homo sapiens
gactttcactttccctttcgaattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctgggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctgg

SEQ ID NO: 2238 - DNA, 624 bp, Homo sapiens
attatacagacgcataactggaggtgggatccacacagctcagaacagctggatcttgctcagtctctgccaggggaagattccttggaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgc

SEQ ID NO: 2239 - DNA, 541 bp, Homo sapiens
atccacacagctcagaacagctggatcttgctcagtctctgccaggggaagattccttggaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatgagagcagtatctttattgaggatgccattaagtatttcaaggaaaaagt

SEQ ID NO: 2240 - DNA, 566 bp, Homo sapiens
attatacagacgcataactggaggtgggatccacacagctcagaacagctggatcttgctcagtctctgccaggggaagattccttgacttctggggtgatggagaagaaacaggctgtgctgtgtccctaatgggaaacgtggctgagacaggggagtgagaagggtgcgttgcagaatggtgcctgtggcatgatgccagctttgcaatcatgagattcaaaagccacactgtggaattgaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgact

SEQ ID NO: 2241 - DNA, 1033 bp, Homo sapiens
atccacacagctcagaacagctggatcttgctcagtctctgccaggggaagattccttggaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatgagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacct

SEQ ID NO: 2242 - DNA, 2685 bp, Homo sapiens
atcagacagtaaaacaggggcagagcctggaattgcactgaggcttgagtctgacttctctcccccacctgctgtgcccttaaactgcagagatcggggcgggggttggggggcaagcggctcagatgggttcaaaaaactccccaggctcaactctggttctgactgcctgagacatgggcagctgacacagcagaccttgaatcctgaggatgtgaggcagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatatcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagaggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgacccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 2243 - DNA, 2544 bp, Homo sapiens
gtgctggggagcagcgtgtttactgtgcttggtcatgagctgctgggaagttgtgactttcactttccctttcgaattccagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatatcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagaggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgacccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 2244 - DNA, 1421 bp, Homo sapiens
attacacagatgcacagctggacgtgggatccacacagctcagaacagttggatcttgctcagtctctgtcagaggaagatcccttgtcaagcctgaggggcagtatccagcctcaacccccagcagaggctccagacaaaggtgggagccaggccaacaatgacccaggaggatgggatcctggatgcagctcctcacaagtattgggcaggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatatcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagac

SEQ ID NO: 2245 - DNA, 577 bp, Homo sapiens
ggtatatctgggaggccggaggacgtgtctggttattacacagatgcacagctggacgtgggatccacacagctcagaacagttggatcttgctcagtctctgtcagaggaagatcccttgaaaagactactgagagccagtaagactgaaagaatggacatcttcatatcctgttagtttgagtgtgaatttgtacagttttcatacagagtggctctaggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagacc

SEQ ID NO: 2246 - DNA, 611 bp, Homo sapiens
ggggaaaacagcttagatgggttcacaaagctccccgggctcagctctggttctgacaccctcagacacggccagctgaccccagaagaaaggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcat

SEQ ID NO: 2247 - DNA, 2117 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcacca

SEQ ID NO: 2248 - DNA, 3563 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcagggtatatctcagagcctggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcacca

SEQ ID NO: 2249 - DNA, 3626 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtgaaggtagcaggtgctcctggcagaagaacccacataaggaagtgtccagaagccacacagggtatatctcagagcctggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcacca

SEQ ID NO: 2250 - DNA, 2220 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttgggttaagaaaaaaaacgaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctgg

SEQ ID NO: 2251 - DNA, 3634 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtatgtttgcattttttgttgtcagtgactaagctgacacataattgggtggaaaatagggtacaagtgtgattgcaagccttgagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctgg

SEQ ID NO: 2252 - DNA, 844 bp, Homo sapiens
atcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcgggacaagcggacttttccttggtgtgagagtgagggaagagggagctggaatgaggtgcagcaaaaccatccaggctggacagtggctggacagttccaagggtcctctgggcccatcccctccccctgtccctacagctggttacagcagctccttctgtgtccattatgtgaacctgctgcctggagttcttgttctttctgtgacctcccagtatccacatctcagcatggccctctgtcagctggctgctcatgactggccgaggttaagctgtgtttgtgtctgacagaagcgcccatctgatatgaccccagttcagattcatagcttgcagtttcatggggggttacagctgttctgaaggtctggttggttttgtttgcccgggaatgtttcaggtctggtttttattttaattttgctttaatattcaccatccccaccccatcaataaaacacaaatttagtgctgg

SEQ ID NO: 2253 - DNA, 1467 bp, Homo sapiens
gaggtgctggggagcagcgtgtttgctgtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaatttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccagcatcgtggagaacacatacacaaggtcagcagaactcacagccagcaggctgactgcaaccagcactgaccaattggaggcattaagggacattctgcgtgacatcacacccaatgtgctttcttttgcacttgattttgacgaagccacaaaaatgattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctag

SEQ ID NO: 2254 - DNA, 1278 bp, Homo sapiens
gaggtgctggggagcagcgtgtttgctgtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctgggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaatttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccagcatcgtggagaacacatacacaaggtcagcagaactcacagccagcaggctgactgcaaccagcactgaccaattggaggcattaagggacattctgcgtgacatcacacccaatgtgctttcttttgcacttgattttgacgaagccacaaaaatgattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctag

SEQ ID NO: 2255 - DNA, 3225 bp, Homo sapiens
gaggtgctggggagcagcgtgtttgctgtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctgggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaagtttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccagcatcgtggagaacacatacacaaggtcagcagaactcacagccagcaggctgactgcaaccagcactgaccaattggaggcattaagggacattctgcgtgacatcacacccaatgtgctttcttttgcacttgattttgacgaagccacaaaaatgattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctaggcccaattgttgcgggaagtcagggaccccaaacggagggactggctgaagccatggcagaagaacgtggattgtgaagatttcatggacatttattagttccccaaattaatacttttataatttcctatgcctgtctttaccgcaatctctaaacacaaattgtgaagatttcatggacactgatcacttccccaatcaatacccttgtgatttcttatgcctgtctttactttaatctcctaatcctgtcagctgaggaggatgtatgtcacctcaggaccatgtgataattgcgttaactgcacaaattgtagagcatgtgtgtttgaacaatatgaaatctgggcaccttgaaaaaagaacaggataacagcaattgttcagggaataagagagataaccttaaactctgaccaacagtgagcctggtggaacagagtcatatttctcttctttcaaaagcaaatgggagaaatatcgctgaattctttttctcagcaaggaacatccctgagaaagagaatgcacccctgagggtgggtctataaatggcctccttgggtgtggccatcttctatggtcgagactgtagggatgaaataaaccccagtctcccatagcgctcccaggcttattaggaagaggaaattcccgcctaataaattttggtcagaccggttgctctcaaaaccctgtctcctgataagatgttatcaatgacaatggtgcccgaaacctcattagcaattttaatttctccccggtcctgtgttcctgtgatctcgccctgcctccacttgccttgtgatattctattaccttgtgaagtaggtgatctttgtgacccacacccacaccctattcatacactccctccccttttgaaagtccctaataaaaacttgctggttttgcggcttgtgaggcatcacggaacctaccgatgtgtgatgtctcccctggacacctagctttaaaatttctctcttttgtactctgtgcctttatttctcaaaccggccaacacttagggaaaatagaaaagaacctacgtgaccatcggggcaggttccccgatacccaatgaccccagagcagtgcagccaccagggaaggtgagccagacacaggccgggacaaaacgcagacattttttaggggaataaagagggcgaggtaaagtttatggaactcagtgttaggaactttggcatctgtagctgagcacagcaggggaggggttactcaagatggcaagtgcgccaaggagaaggcagaaatgctggggcctggaataagggaggagaggggactggagagtgtggggaatggaaagaagcagtttactctagactaaagagtatattgggggaggaagagagggaggcacgtaggaacaagcaatgagaagaccaggaaaagaaagagctgaaaatggagaaagccacagttagaactgttggatacaggagaagaaacagcggctccactaaagacccgccccccggttggatgtccttccaagaatggaatccttccctggtgatggtctctcaccctgtcttaccagcatccactctcccttgtcctcccgggggtgtatctgagtcagccagtggcttcttgatgatggtggtggtggttgtagtgtgacaggtcccctttaggttatttaagggtgcatgtcccctgcttgaaccctgaaggccgggtaatgagccatttccatggtgcccagctgaggaccaggtgtctctgagaatccaaacatcctggagagtatctgagaaccaaccaagtaaaagtctcgttgctcatatatagtagacaaagagccagaaaattaactgaaaagcagtttagacattgggggaggctggatctctcgagctgtcttgctgagtgccctgtgtgtaagtcctaataaacttagctactcgcca

SEQ ID NO: 2256 - DNA, 3414 bp, Homo sapiens
gaggtgctggggagcagcgtgtttgctgtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaagtttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccagcatcgtggagaacacatacacaaggtcagcagaactcacagccagcaggctgactgcaaccagcactgaccaattggaggcattaagggacattctgcgtgacatcacacccaatgtgctttcttttgcacttgattttgacgaagccacaaaaatgattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctaggcccaattgttgcgggaagtcagggaccccaaacggagggactggctgaagccatggcagaagaacgtggattgtgaagatttcatggacatttattagttccccaaattaatacttttataatttcctatgcctgtctttaccgcaatctctaaacacaaattgtgaagatttcatggacactgatcacttccccaatcaatacccttgtgatttcttatgcctgtctttactttaatctcctaatcctgtcagctgaggaggatgtatgtcacctcaggaccatgtgataattgcgttaactgcacaaattgtagagcatgtgtgtttgaacaatatgaaatctgggcaccttgaaaaaagaacaggataacagcaattgttcagggaataagagagataaccttaaactctgaccaacagtgagcctggtggaacagagtcatatttctcttctttcaaaagcaaatgggagaaatatcgctgaattctttttctcagcaaggaacatccctgagaaagagaatgcacccctgagggtgggtctataaatggcctccttgggtgtggccatcttctatggtcgagactgtagggatgaaataaaccccagtctcccatagcgctcccaggcttattaggaagaggaaattcccgcctaataaattttggtcagaccggttgctctcaaaaccctgtctcctgataagatgttatcaatgacaatggtgcccgaaacctcattagcaattttaatttctccccggtcctgtgttcctgtgatctcgccctgcctccacttgccttgtgatattctattaccttgtgaagtaggtgatctttgtgacccacacccacaccctattcatacactccctccccttttgaaagtccctaataaaaacttgctggttttgcggcttgtgaggcatcacggaacctaccgatgtgtgatgtctcccctggacacctagctttaaaatttctctcttttgtactctgtgcctttatttctcaaaccggccaacacttagggaaaatagaaaagaacctacgtgaccatcggggcaggttccccgatacccaatgaccccagagcagtgcagccaccagggaaggtgagccagacacaggccgggacaaaacgcagacattttttaggggaataaagagggcgaggtaaagtttatggaactcagtgttaggaactttggcatctgtagctgagcacagcaggggaggggttactcaagatggcaagtgcgccaaggagaaggcagaaatgctggggcctggaataagggaggagaggggactggagagtgtggggaatggaaagaagcagtttactctagactaaagagtatattgggggaggaagagagggaggcacgtaggaacaagcaatgagaagaccaggaaaagaaagagctgaaaatggagaaagccacagttagaactgttggatacaggagaagaaacagcggctccactaaagacccgccccccggttggatgtccttccaagaatggaatccttccctggtgatggtctctcaccctgtcttaccagcatccactctcccttgtcctcccgggggtgtatctgagtcagccagtggcttcttgatgatggtggtggtggttgtagtgtgacaggtcccctttaggttatttaagggtgcatgtcccctgcttgaaccctgaaggccgggtaatgagccatttccatggtgcccagctgaggaccaggtgtctctgagaatccaaacatcctggagagtatctgagaaccaaccaagtaaaagtctcgttgctcatatatagtagacaaagagccagaaaattaactgaaaagcagtttagacattgggggaggctggatctctcgagctgtcttgctgagtgccctgtgtgtaagtcctaataaacttagctactcgcca

SEQ ID NO: 2257 - DNA, 543 bp, Homo sapiens
gtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctgaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgt

SEQ ID NO: 2258 - DNA, 1823 bp, Homo sapiens
gtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggtgagcttggctcagagccctgaggtgggagggagggctccctgtctgggctgcacaattgggcagggcttgggctgggccaggagccatgtgggtttttctaggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaagtttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccagcatcgtggagaacacatacacaaggtcagcagaactcacagccagcaggctgactgcaaccagcactgaccaattggaggcattaagggacattctgcgtgacatcacacccaatgtgctttcttttgcacttgattttgacgaagccacaaaaatgattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctaggcccaattgttgcgggaagtcagggaccccaaacggagggactggctgaagccatggcagaagaacgtggattgtgaagatttcatggacatttattagttccccaaattaatacttttataatttcctatgcctgtctttaccgcaatctctaaacacaaattgtgaagatttcatggacactgatcacttccccaatcaatacccttgtgatttcttatgcctgtctttactttaatctcctaatcctgtcagctgaggaggatgtatgtcacctc

SEQ ID NO: 2259 - DNA, 575 bp, Homo sapiens
actgcaggaggtgctggggagcagcgtgtttgctgtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctgactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagag

SEQ ID NO: 2260 - DNA, 520 bp, Homo sapiens
gtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctgcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagag

SEQ ID NO: 2261 - DNA, 616 bp, Homo sapiens
acttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccaggtaacctccatggggttacctccttggggcaccccggtgatgccacccagatctccccgggctagttttctctggcaggcacacctcctccaggcagccccctctgctgggcttgaggatgtccctctcagcagtgcaggaagaatatttcctccaagtgcttcgctggcagtgagtgacctcaggctgaggggagaagaagcccacaagggcaggggaagaggcagatgctctctatgaagctctgaagaatcttacaccata

SEQ ID NO: 2262 - DNA, 1438 bp, Homo sapiens
atgccatgtggcaaacaaggaaatttgcaagttcccggttccaaggtgttacctggcttgggagaaggttgtaaagaaatgtggcttcgaaaggtaatctacggaggtgaggtctgggggaagtccccagaacctgagttcccctcactcgtgaacctgtgccagagttggaaaattaacaatttgatgtcaactgtccacagtgatgaggctggtatgctgtcctactttctgtttgaagagctgatgcgatgtgacaaagattccatgccagatggaaatctgtcagaggaggaaaaattgtttctctcatattttcctttgcacaagtttgagctagaacagaacatcaaagaacttaacacccttgcggaccaagttgacaccactcacgagttgcttaccaagaccagcctggtggccagctcttccggggctgtttctggggtcatgaacatcctgggtttggccctagcacctgtgacagcaggaggcagtctcatgctctcagcaactgggacagggttgggggcagcagctgccatcaccaacatagtaacaaatgtcttagaaaatagaagcaattcagcagcaagagacaaagccagccgactggggcctctgacaacatcacatgaggctttcggaggaataaattggtctgaaatcgaggctgctggcttttgtgttaataagtgtgtaaaagctatccagggcatcaaggatcttcatgcctaccagatggccaaatccaactctggcttcatggctatggtcaagaattttgtggccaagagacacatccctttctggacggctagaggggtgcagagagcctttgagggcacaactctggccatgaccaatggtgcctgggtgatgggtgctgctggggctggcttcttacttatgaaagacatgagcagcttcctgcagagctggaagcacctggaggatggggcaaggacggagacagcagaggaactgagagcacttgctaagaagctggagcaggagctggaccggctcacccagcaccaccggcacctgccgcagaaggcgagccagacctgttccagctcccggggcagggctgttcgaggatcccgtgtggttaaaccagaagggtctcgctcacctctcccctggcctgttgtggagcaccagcctaggctgggccctggcgtggcactgaggacaccaaagaggacagtctctgccccaaggatgcttggccaccagccagccccaccagcaccagcaagaaaggggagacaggccccgggaagacaccgacaatgagaagagttggtcaccctgtcaccactgaaccttgatttaacagaggcaaaatgcaagtcttccctgaagaatactgggggtagggaaacttctagtggcaatgataaaaccagcagcaatgataatagaaggcaaa

SEQ ID NO: 2263 - DNA, 3069 bp, Homo sapiens
gaagagccctagagctttgctttttctctcctgcagcacttaaccgaaaccagttttgcaatcaattcctgttcaaaggccaccctactcttcctatccgtctttctccagcccagacactcacagccccctgccagaccaggggacctcggagaggcaaggacagaggttcaggatcttcctctccctcgggacccaaggccacaaaggagagctccgtggagagaagaaaatcatttgactcctggggacacagatttgctgccacagaggctgatggacaaccaggcggagagagaaagtgaggctggtgttggtttgcaaagggatgaggatgacgctcctctgtgtgaagacgtggagctacaagacggagatctgtcccccgaagaaaaaatatttttgagagaatttcccagattgaaagaagatctgaaagggaacattgacaagctccgtgccctcgcagacgatattgacaaaacccacaagaaattcaccaaggctaacatggtggccacctctactgctgtcatctctggagtgatgagcctcctgggtttagcccttgccccagcaacaggaggaggaagcctgctgctctccaccgctggtcaaggtttggcaacagcagctggggtcaccagcatcgtgagtggtacgttggaacgctccaaaaataaagaagcccaagcacgggcggaagacatactgcccacctacgaccaagaggacagggaggatgaggaagagaaggcagactatgtcacagctgctggaaagattatctataatcttagaaacaccttgaagtatgccaagaaaaacgtccgtgcattttggaaactcagagccaacccacgcttggccaatgctaccaagcgtcttctgaccactggccaagtctcctcccggagccgcgtgcaggtgcaaaaggcctttgcgggaacaacactggcgatgaccaaaaatgctcgcgtgctgggaggtgtgatgtccgccttctcccttggctatgacttggccactctctcaaaggaatggaagcacctgaaggaaggagcaaggacaaagtttgcggaagagttgagagccaaggccttggagctggagaggaaactcacagaactcacccagctctacaagagcttgcagcagaaagtgaggtcaagggccagaggggtggggaaggatttaactgggacctgcgaaaccgaggcttactggaaggagttaagggagcatgtgtggatgtggctgtggctgtgtgtgtgtctgtgtgtctgtgtgtatgtacagtttacatgaatgttcctcaggacatggcatacaatggccttggaggtccaaataatatcaagtacatcttggagatgagggtgcctgtcctggacagacctcggcatgccttctgtttctccttcaatgctccttaaggcctatgtgctgggaaaagggtcttccctgtttgtttgtttgtttgtttgtttgtttgttttgagacagggtctctgttgcccaggctggagtgcagtggcgtaatctcggctcactgcaacctctgcctcctgagtgcaagcaagtctcctgcctcagcctcccaagtagctgggattacaggcacgcaccaccacgcccagctaattttggtatttttttgtagagacagggtttcaccattttggccaggctggtctcgaattcctgacctcaagtgatccacccaccttggcctcccaaaatgctgggattacaagcgtgagctaccctgcccagccgggtcttcccagttttaacaaagaggtcacagagccacaggcggagttaggaactaaattgtctcctcctcccaattcatatgttgaagtcctaaaccaaaatgtggctgtatttagagatggaccctttgggaggtaattagggttgactgaggccatagggtgaggtcctaacccgatggaattgacttctttataagaggaggaggaaatacaagagggcctccccacccctgctgcacacctacactgaaggaaggctatttgcagatgcagcaagaaggcagccatctgcaaggcagaagaagagagccctcaccaggaactgaataagtcagtcagtctgggacttccagcctctagaactgtgaaacaataaatttctgtggtgtaagcaactcaatctatagtagtttgttactattttgttatagcaaccaaagatgactaagccagacaggttatgtcactcgccaagtgtcttagtctgtttgtgctgctataacaaaataccttagactgggtaatttacaaacaacagagatgtatccagagatccacagttctggaggctgagaagtctaaaatcaaggcaccagcagattccacatctcgtgaaggctcactctctgcttcacagatggcactgtcttgctgtgttctcacatggcagaaggggcaaacaagcccccctgggcctcttttataaaggcactaactctatgcctaaaggcagggccctcatgactctatcacctaccaaaaggctccacttctttatactattggaggggtagaaggaacttcctttctagaccttgaaggtttaagaatttgaatctataaaacaagctgacaatagacagattaacaggagaaaaagcatatacattttttaatgtgggccagatggcagaagcttaaataacaccccaagctacaggaagtgaggcctctgatggggaggtagtgacacaggctgtgggagggggtagggggaggaagtctgtggtgagcaaagtttgccttattacactgataaagtgtaattacactaataaagctggatcacctgaggttaggagtttgagaacagcctggccaacatggcaaaaccctgtctctactataaatacaaaaattagccaggtgtagtggcagggcacttgtaatcctatctactcgggaggctgaggcaggagaatcgcttgaacccaggctgtaaaggttgcagtgagccaagatcatgccactgcactccagtctgggtgtcagaatgagaccccatctc

SEQ ID NO: 2264 - DNA, 1056 bp, Homo sapiens
gggtttgcgttcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcagacagctatgactatctccaaaatgcacctcctgttttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagtt

SEQ ID NO: 2265 - DNA, 1118 bp, Homo sapiens
gcgttcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaaa

SEQ ID NO: 2266 - DNA, 714 bp, Homo sapiens
gtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagtta

SEQ ID NO: 2267 - DNA, 2140 bp, Homo sapiens
aatcccttcaaccttctgcgcgcttccgccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctctgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgcggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 2268 - DNA, 3117 bp, Homo sapiens
agtcggagccgggcttgcccgggcatgtgggagctgccggctttccggacgccacgtgcagaccggaagagacacgcggggcttcaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcaatgtcctctatgacaagtacatcaggcctgagatgcccatcgctgactaccgtacccgctggagtggcatcactcggcagcacatgcgcaaggctgtccccttccaggtggcccagaaagagatccttaagctcctgaagggcaaggtggtggtggggcacgcgctgcacaacgacttccaggcgctcaagtatgtccaccctcggagccagacccgggatacgacctatgtcccaaacttcctcagcgagcccggcctccacacccgggcccgggtctctctaaaggacctggccctgcagctgctgcacaagaagatccaggtgggccagcacgggcactcatcagtagaagatgccacgacagccatggagctctaccggctggtggaggtgcagtgggaacagcaggaggcccgcagcctctggacctgccccgaggacagagaacctgacagcagcacagacatggaacagtacatggaggaccagtactggcccgatgacctggcccacggcagcagaggaggagccagggaggcacaggacagaaggaattgagaagggggcggggctccctggctgggcttccggtgtggccggtaggaagtgggggccaggagagcagcgggcactccttcctgggcagggtggggcaggatgcagtgagccagccccagggccagaggagtaggggtcatctgttaccttgacaccctctgcacacagcatagccctctctctctccagggctgttggttctttcttctgactcctgtggttttgctaatggcactttacagactccatggagatgtcaggtggaccatcttctagggcccagcaggagtagggaatgtgccaacagactgcccaggttgccgtggccttccccaccccccagatctcctgagtcatcatgctgtgctaatgaaagggatcatatcatcctctctggggatggtgggtgggggtgtcaatatcctggagctcccttaccccaactcaatgacttgggggtaaagttctcttccttttgttgcctacctcttcctccactcatttgggttcagaataaacatgtcctgaagttaaagaggagttaagtcctaaaggaggcatttcttccccacctccctgacctggaactctggctacagccattgtaggaactccgtgcctggcctgtcagctccctgctaggctacagtggaatagcagagcccacaggcttctcgtggggagttggctccttaacatttcttggcaacagaaagccccaggcacagctcagggaggagggaaggcaggtaagctttggacgagaactggcatatttattttgacccaaatcagggatttccccagtccacccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgaggctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtacagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggtgctgttatcagcggggaaatgtactatttaagatcagctttgttgtaaaaccatttgttctagaataaaactcaattggaaacgtgg

SEQ ID NO: 2269 - DNA, 1067 bp, Homo sapiens
gagacacgcggggcttcaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcaatgtcctctatgacaagtacatcaggcctgagatgcccatcgctgactaccgtacccgctggagtggcatcactcggcagcacatgcgcaaggctgtccccttccaggtggcccagaaagagatccttaagctcctgaagggcaaggtggtggtggggcacgcgctgcacaacgacttccaggcgctcaagtatgtccaccctcggagccagacccgggatacgacctatgtcccaaacttcctcagcgagcccggcctccacacccgggcccgggtctctctaaaggacctggccctgcagctgctgcacaagaagatccaggtgggccagcacgggcactcatcagtagaagatgccacgacagccatggagctctaccggctggtggaggtgcagtgggaacagcaggaggcccgcagcctctggacctgccccgaggacagagaacctgacagcagcacagacatggaacagtacatggaggaccagtccacccagtactgggctcttaagcaaaagtctgagaaacaagacagtggtttgaattctggggcctttgtgtag

SEQ ID NO: 2270 - DNA, 3714 bp, Homo sapiens
gcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatcttcctcgagtggcagatatactaacgcaacttttgcagacagatgactctgcagaatttaacctagtgaacaatgccctattaagtatatttaaaatggatgcaaaagggactttaggtgggttgttcagccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtaggatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatttt

SEQ ID NO: 2271 - DNA, 2009 bp, Homo sapiens
gactggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagattcgacgtcaagcaattaaagaactgcctcaatttgccactggagaaaatcttcctcgagtggcagatatactaacgcaacttttgcagacagatgactctgcagaatttaacctagtgaacaatgccctattaagtatatttaaaatggatgcaaaagggactttaggtgggttgttcagccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtg

SEQ ID NO: 2272 - DNA, 1868 bp, Homo sapiens
gtgcgcggtgactggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatcttcctcgagtggcagatatactaacgcaacttttgcagacagatgactctgcagaatttaacctagtgaacaatgccctattaagtatatttaaaatggatgcaaaagggactttaggtgggttgttcagccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagcagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgt

SEQ ID NO: 2273 - DNA, 1760 bp, Homo sapiens
agcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatcttcctcgagtggcagatatactaacgcaacttttgcagacagatgactctgcagaatttaacctagtgaacaatgccctattaagtatatttaaaatggatgcaaaagggactttaggtgggttgttcagccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatggtgagcgtttccgtttgggtacaaggaatatgagagattaggcagaaattgtgttatactttattttaattagtaattatatacagtgtcatggttctatccaatgacttttctgaattagcttggagaactagggctgttgaggaaatgatttatcccattcctctctcattcacccttctgggctgactgtattgaacatgcaacattaaacagtaagcacttaaagaaaaata

SEQ ID NO: 2274 - DNA, 1605 bp, Homo sapiens
gcaccccgcgcctcgctgctaccgggcgcctttcgctcgcggctcctccgtgcggcccgcttccggtggggccagggcgtctccgccgcagctcggctcccgcgcgctcagcaccgccagcggcggccagatgcaggcggagcgaggagctcggggaggccgtgggcggcggccaggccgcggccggcctggcggagatcgccacagcgagcggcccggagccgcagcggcggtagccagaggcggcggcggaggcggcggcggggacggaggcggacgccggggccgtggccgtggccggggcttccgcggcgctcgcggaggccgaggaggaggaggcgccccgcgaggcagccgccgggagccgggaggctggggcgcaggggccagcgcgccggttgaagatgacagcgatgcagagacctatggagaagagaatgatgaacagggaaattattctaaaagaaagattgtctctaactgggatcgatatcaagatattgaaaaagaggtcaataatgaaagtggagagtcacagaggggaacagatttcagtgtcctccttagctctgcaggggactcattctcacagttccggtttgctgaggagaaagaatgggatagtgaagcttcttgtccaaaacagaattcagcattttatgtggatagtgagttattggttcgagcccttcaagagctgcctctctgcctccgactcaacgttgctgccgaactggtccagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagagggagataacatcttaccagatcagacgtctcaggacctgaaatccaaggaagatggggaggtggtccaagaggaagaagtttgtgcaaaaccatctgtgactgaagaaaaaaacatggaacctgagcaaccaagtacctccaaaaatgttaccgaggaagagctggaagactggttggacagcatgatttcctaaaaaggggaaaaaaagtgcctgaagcaaatcttggttgccttctaacggcaggtgggcataaggctgtccttcaggaccagccagtttacaagcatgtctcaagctagtgtgttccattatgctcacagcagtaaatgcctacctctgtgtttgacatctgaaagaatacattgaagcagcttgttgcatttgtttttctggcttagtaatctaatagatttccttaagggcaggagatagactctggcccttgtttctagcctccttccttgcagtgtttacaacatagccagtgtttacagcatagcagatgctgctgctgattaagagaatagatgcaaacaaggcatgcatttggccaaaataaacaaatgctggtctgtcca

SEQ ID NO: 2275 - DNA, 5257 bp, Homo sapiens
atgcccgccggccgctggcccggccatgtcgtcgtccttcttcaaccccagcttcgccttcagctcgcacttcgaccccgacggcgccccgctcagcgagctgtcctggccatcctccctcgccgtggtggctgtgtctttctccgggctcttcgccgtcatcgtcctcatgctggcctgcctgtgctgtaagaagggcggtatcgggttcaaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaattttgagtacaagtgggaggcgggccgcggcgcggaggccttcccggccacgctgagccctggccgcaccgcacgcctgcaggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagacaaaagaaa

SEQ ID NO: 2276 - DNA, 4928 bp, Homo sapiens
gatgcggcggctcgggccggggccgcgggcgtcctgagcgcagcgccctcccgggatgcccgccggccgctggcccggccatgtcgtcgtccttcttcaaccccagcttcgccttcagctcgcacttcgaccccgacggcgccccgctcagcgagctgtcctggccatcctccctcgccgtggtggctgtgtctttctccgggctcttcgccgtcatcgtcctcatgctggcctgcctgtgctgtaagaagggcggtatcgggttcaaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagct

SEQ ID NO: 2277 - DNA, 5081 bp, Homo sapiens
gccaccaggtgaaggtccaaggctgctggggcagatggcggtggcaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaattttgagtacaagtgggaggcgggccgcggcgcggaggccttcccggccacgctgagccctggccgcaccgcacgcctgcaggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaaga

SEQ ID NO: 2278 - DNA, 796 bp, Homo sapiens
gggaaaatccgacctggccgcgcaccaccgccccttctcggccctcctgcgtttgcccagggtcggcccgcagtgatggaggaggaggcggagaccgaggagcagcagcgattctcttaccaacagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcaaatggtatatattagaaattacatctgttgtaattaaaattgtgtgagcaattaaa

SEQ ID NO: 2279 - DNA, 1469 bp, Homo sapiens
ggagctcctgataatgtgtactgcgttacatgatctgtaaatcgtgggctacgcatcctctacacccgactggaacacgctttgcacctatgcgcacacgtgtttcgcggagagtggtgctcagcgttgtgccaggcgctgaatcaggctctggggtgcagcagtgacctcggtggtcatgtccccgcgtcgcccggccacctccgcagagcaagctgagcagggggctggctggaggccgacggcggaatcccctcaacggagcgccgccagggggcgcgcgaggcagggcggagctgcgtactttgtccgcccgcgcggcccgtcgctcgcgccgcggcgggaaaatccgacctggccgcgcaccaccgccccttctcggccctcctgcgtttgcccagggtcggcccgcagtgatggaggaggaggcggagaccgaggagcagcagcgattctcttaccaacagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcagaataacatcttatttcagtttatgaattgatatgaattgtctaatttaaaaaatatttccctcacattaaaagcaaatttttaatatcaggctcgaagagcaaaatgattattcctcatgttttagctgaaattaattttaaaacatattaaacagaaaacctgctgacatgcctgtgaaactgatactcgaacttgctgttatgtaccagttttaattagtagcttaatgggttgcaa

SEQ ID NO: 2280 - DNA, 1402 bp, Homo sapiens
ggagctcctgataatgtgtactgcgttacatgatctgtaaatcgtgggctacgcatcctctacacccgactggaacacgctttgcacctatgcgcacacgtgtttcgcggagagtggtgctcagcgttgtgccaggcgctgaatcaggctctggggtgcagcagtgacctcggtggtcatgtccccgcgtcgcccggccacctccgcagagcaagctgagcagggggctggctggaggccgacggcggaatcccctcaacggagcgccgccagggggcgcgcgaggcagggcggagctgcgtactttgtccgcccgcgcggcccgtcgctcgcgccgcggcgggaaaatccgacctggccgcgcaccaccgccccttctcggccctcctgcgtttgcccagggtcggcccgcagtgatggaggaggaggcggagaccgaggagcagcagcgattctcttaccaacagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcagaataacatcttatttcagtttatgaattgatatgaattgtctaatttaaaaaatatttccctcacattaaaagcaaatttttaatatcaggctcgaagagcaaaatgattattcctcatgttttagctgaaattaattttaaaacatattaaacagaaaacctgctgacatgcctgtgaaactgatactcgaacttgctgttatgtaccagttttaattagtagcttaatgggttgcaa

SEQ ID NO: 2281 - DNA, 2018 bp, Homo sapiens
agcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagagtagctgggatttgacttttcttccttgcctgcagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagttgt

SEQ ID NO: 2282 - DNA, 1143 bp, Homo sapiens
ggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaagaaagtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttc

SEQ ID NO: 2283 - DNA, 1200 bp, Homo sapiens
ggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttc

SEQ ID NO: 2284 - DNA, 1820 bp, Homo sapiens
atgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaa

SEQ ID NO: 2285 - DNA, 2023 bp, Homo sapiens
agcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagagtagctgggatttgacttttcttccttgcctgcagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagttgtattca

SEQ ID NO: 2286 - DNA, 1740 bp, Homo sapiens
cagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaaca

SEQ ID NO: 2287 - DNA, 1873 bp, Homo sapiens
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttgg

SEQ ID NO: 2288 - DNA, 1455 bp, Homo sapiens
gaggtgttgctgtgttgcccaagctggacttgaacccctaggctcaagcaatccttccacctcagtctcccaagtagcagggactacagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggtt

SEQ ID NO: 2289 - DNA, 1068 bp, Homo sapiens
gacgtcatcccgcagcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaa

SEQ ID NO: 2290 - DNA, 2106 bp, Homo sapiens
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaa

SEQ ID NO: 2291 - DNA, 1029 bp, Homo sapiens
agctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccaggagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaa

SEQ ID NO: 2292 - DNA, 2752 bp, Homo sapiens
ctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 2293 - DNA, 1140 bp, Homo sapiens
gagagggtggagacaatagggaggcaggcacagaggagaaagaggggtggagggagccaggacctcaccgaaggcctcctcagccctggaatttagatgcagtcgggcatggggtggaatgttctggacttttgggtatgaagccgtgtcccctgctgggccttcccacctttttgcatctcttctcctaggagtgctcctgaccatcaccttcatgcctggggctcgccccttgcctctggtcttggtaccccagaataccctggcctggatgcagctggatgcaaaggccccagctcaccccaggcctctccagcttctaggcagagtggggcctgggtctaggcagctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcct

SEQ ID NO: 2294 - DNA, 1009 bp, Homo sapiens
aagcaatgggagacaggccttggaccaaggaaagagacggggtggagaaggagagagagagggtggagacaatagggaggcaggcacagaggagaaagaggggtggagggagccaggacctcaccgaaggcctcctcagccctggaatttagatgcagtcgggcatggggtggaatgttctggacttttggctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcc

SEQ ID NO: 2295 - DNA, 2652 bp, Homo sapiens
atggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 2296 - DNA, 1524 bp, Homo sapiens
cttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaacatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctg

SEQ ID NO: 2297 - DNA, 2487 bp, Homo sapiens
taaaagtggcccaggagagtgctcctgaccatcaccttcatgcctggggctcgccccttgcctctggtcttggtaccccagaataccctggcctggatgcagctggatgcaaaggccccagctcaccccaggcctctccagcttctaggcagagtggggcctgggtctaggcagctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 2298 - DNA, 2152 bp, Homo sapiens
tccgccgccgcgcccgcctacaaggccctgagggagactgcggagggtgagtgcgcggtgggctcggctgaccgttggccctgcggccggcgccctaggctacctcccttcgcctccccgcgcctccccgcgcctccccgcctccccgcctccccgcctcctcggctctggttccaacaccccagcgccaagccggggaggcggggaggacttcttaagtgtgccgctcgggagcctcccgctcgtcccgccccgaggggcgtgaggaggggaggggctgcggacttcggactcgggcctggagaccgcctcctacccagagccggagcccgcaacccgctcaggcggcgacggagccatgtcgccgctgctggggctccggtccgagctgcaggacacctgcacctcgctgggactgatgctgtcggtggtgctgctcatggggctggcccgcgtagtcgcccggcagcagctgcacaggccggtggcccacgccttcgtcctggagtttctagccaccttccagctctgctgctgcacccacgagctgcaactgctgagcgaacagcaccccgcgcaccccacctggacgctgacgctcgtctacttcttctcgcttgtgcatggcctgactctggtgggcacgtccagcaacccgtgcggcgtgatgatgcagatgatgctggggggcatgtcccccgagacgggtgcggtgaggctattggctcagctggttagtgccctgtgcagcaggtactgcacaagcgccttgtggagcttgggtctgacccagtatcacgtcagcgagaggagcttcgcttgcaagaatcccatccgagtcgacttgctcaaagcggtcatcacagaggccgtctgctcctttctcttccacagcgctctgctgcacttccaggaagtccgaaccaagcttcgtatccacctgctggctgcactcatcacctttttggtctatgcaggaggaagtctaacaggagctgtatttaatccagctttggcactttcgctacatttcatgtgttttgatgaagcattccctcagttttttatagtatactggctggctccttctttaggtatattgttgatgattttgatgttcagctttttccttccatggctgcataacaaccatacaattaataaaaaggaataactgttccaaagactcagactaacatacaggacagtccagctggatgtgataaagattttatcacctcatatggaaaacaccggctgcactggattcatcagtgttaacttcctttgaggaagctgccttatagttttcatcactgggactttaaaaaaaaattactgtgaaaatgaggtattctgtacttctcagttaagacttgttctttgagtgatgtattaaatgctgctagaaaagcctcattacattaaatataaatcaatcttaaatgataattgttaactttgatgaaaaacgagtacaggatgagaagggaagtaaaggtgatagtaagatcaacgaatttgtgtatcaagtgtcacccaaatgaacagaatttttaactataaaagtacaaggcgtcaacttacagaactggggagaggatactttcagccaccacctcacaaaatgataccatcaagcagtgtcatctttcaacaggaaagttgcttttagaagtagaatatatattcactcacatgcaagcgatttcctacattttaagtacattaaaatctaatacctaaaatagtttctctaaatagacaatctcactagctccagccaagtggttattctttaatagaatataataaaacaaaacacccatacaaagtcaggatttaagcttttcacattctcctttgaaccaacagctagctaccttatgaagtagggagggcatgtatttttaatctccattttacagataaggaaactaagcctagatgggtttgctgccctggcttagatcacatagagccaaataccatctctagtcttcaacttcaatccaaaaattcttctcggtcacgattatgactaaagggaaatcaagggttcatagaaacattaaatactttataataacgttaaaacttgtttagaaattaactagtattttttgaggtttaaagaaccttccagttttac

SEQ ID NO: 2299 - DNA, 1084 bp, Homo sapiens
gaaccagccagctcctgctctgtcccctcaggtgtcctgcaggcacagctcctcggggggcccaggccgatggcaggtcttaacgtgtccctctccttcttctttgccaccttcgccctctgtgaggcggccaggcgggcctccaaggccctgctcccagtgggcgcctatgaagtcttcgcccgggaggcgatgaggacgctggtcgagctcgggccctgggctggggactttgggcctgacctgctgctcaccctgctcttcctgctcttcctggcgcacggggtcaccttggacggggcctcggccaaccccactgtgtccctgcaggagttcctcatggccgagcagtctctgcctggcacgctgttgaagctggcggcacaggggctgggcatgcaggccgcctgcaccctgatgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttctaaga

SEQ ID NO: 2300 - DNA, 3009 bp, Homo sapiens
gaaccagccagctcctgctctgtcccctcaggtgtcctgcaggcacagctcctcggggggcccaggccgatggcaggagttcctcatggccgagcagtctctgcctggcacgctgttgaagctggcggcacaggggctgggcatgcaggccgcctgcaccctgatgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagaggagcagcatggggaggtcatggagccccctcttggacctagatctggggattctggcccctggcttcagaggcccaggtggagcccacaccttctcctgcacctgctctcagacactcggctccacctcactgaggtaccagaagggcagctgggttcctatggaattctggaagcttttttcagcttctgctggctctacactggggaggtctcaggggcaatgcctcagcctccccttggggggaaagacaggagctgggggtctctcaggcacctggccctgcgatggtgacactgacgtcatcgtgatttgtcgccatggttctgatgtggtcacagtctctcaggcatgtgcagggtcctaggaagcatatgaagtgcatcaggaaccccctcctgcccccgttgccgaggcagcactgccctctgctaggaacagctccgtgttggcctctctgtccccacacactgggcctgcagggcttctccgagactcttcagttcaggtatcaaccctgggctgtctcctgggatgtggggggcggatgttctttccttgcctccccacgctcctcctgcggatccttcactccgggtgggtcggcctcttcctcctgatcagctccagagccccctctagttccctggcatggaaacacggcccgggtgagctgtggtggccccggaggcctctccgctcctgcacaggccttgcttcctgcgggtgacgaggtcctggactctctcctgcccaggcttctgggtgctttccttagttcagcaccagtgctctgtgtgggcagcgtctcccccgaggatccgcagctccgggttacccgcaggcgtccatctccggtatggtgctgcccttcactgatcctggttgtatttctgtttcctgctttcctcatcgcctcctgtttcggttgattccttctttttgctggtgcccgtctcacagtagcttcctgagaacggggacctggcaggtacacttcagacctcctgtgtctgaaatagtgtcctggttctgacctgcacttgagtgtcggtgaggcctgggcagggttccgggtgggagctcagtttcgtcctgagtttctcaggccccaaccatggcctgtggtggcttcacgggctacaaggcaaaggacgcaaacgaagaggcttcacgtgacagggttgtatgctcagccagctctggaggctggagtctgagctggcagcactgacagggtcagctctcctcggaggctgctggggaggagcctcctgcctcttccgggctccgggggcctctggcacccccggtgtccccgggcttggagacgcagcactcccatgtctgccggttcccctggccgcctcctctgtgtcattgtctgttctcttcatatagggacaccagtcattgaattggaggttcactctactcaagtatgacgtcaccgtgatttcactgattttatgtcccaggccgtattctaacaagggcacatcctgtgttctgggaagggcgtgtcgctggggaaatactcttcacccggctgcaacctctcactgtagaactgcctctgtggagaagcccaaagggcatttgcggcttctaggagccaagtaggaggaggctgggatccgtgtttcaggcgggactccaggcttgggcgggcctgatactcgagtccacatgccccctctagagaggaacctgtctcctgccagggccagggaggggggcactggctgcttctgtattttggggtttggggccctggagcttcccatgcggaattgccgtccctcctcctaggcgagtcccagggccaccccatcccacagggacccgggcgccagcttctgaaagcatggggcatctgcggaagaactgggttgtttcccagctttcgtccctgcggaggggcgatccggcccctccatgtcagcagtgtttggtcgtccacatgcttgtcagccccacgctgtgctcctgcgtctcttcccgtctcatccatctggatgcttgacacctctgacagcatccctttcctgtcatcttagggcagcttcaggaaaccgaaaaacaggcttgtgtccttccattaacccctttatccacaagttcagtatcagcatgagccctggggagctccaaggctgcagccaggagccccgtagccagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttct

SEQ ID NO: 2301 - DNA, 1110 bp, Homo sapiens
gccagctcctgctctgtcccctcaggtgtcctgcaggcacagctcctcggggggcccaggccgatggcaggtcttaacgtgtccctctccttcttctttgccaccttcgccctctgtgaggcggccaggcgggcctccaaggccctgctcccagtgggcgcctatgaagtcttcgcccgggaggcggtgggtgcggtgcagctcgggccctgctgcctggagatgaggacgctggtcgagctcgggccctgggctggggactttgggcctgacctgctgctcaccctgctcttcctgctcttcctggcgcacggggtcaccttggacggggcctcggccaaccccactgtgtccctgcaggagttcctcatggccgagcagtctctgcctggcacgctgttgaagctggcggcacaggggctgggcatgcaggccgcctgcaccctgatgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttct

SEQ ID NO: 2302 - DNA, 4174 bp, Homo sapiens
gaaagagagcgatagagtgcgagagcgagtgcccggagcatcctggccctgagacagctgggccagccccgcagggctctgcagcatgtgggagctccgctccatagccttctccagggctgtgttcgcagagttcctggccacactcctcttcgtcttctttggcctcggctctgccctcaactggccacaggccctgccctctgtgctacagattgccatggcgtttggcttgggtattggcaccctggtacaggctctgggccacataagcggggcccacatcaaccctgccgtgactgtggcctgcctggtgggctgccacgtctccgttctccgagccgccttctacgtggctgcccagctgctgggggctgtggccggagccgctctgctccatgagatcacgccagcagacatccgcggggacctggctgtcaatgctctcagcaacagcacgacggctggccaggcggtgactgtggagctcttcctgacactgcagctggtgctctgcatcttcgcctccaccgatgagcgccgcggagagaacccgggcacccctgctctctccataggcttctctgtggccctgggccacctccttgggatccattacaccggctgctctatgaatcctgcccgctccctggctccagctgtcgtcactggcaaatttgatgaccactgggtcttctggatcggacccctggtgggcgccatcctgggctccctcctctacaactacgtgctgtttccgccagccaagagcctgtcggagcgcctggcagtgctgaagggcctggagccggacaccgattgggaggagcgcgaggtgcgacggcggcagtcggtggagctgcactcgccgcagagcctgccacggggtaccaaggcctgagggccgccagcggcctctacggccccgacggacgcttgtgaggcccgaggcagaagggcccaccccgtccctcctctcccgcaggtctgaagttggccccccagcgcagagtagctgcttcctggacgtgcgcgcccaggccagtgctgtgagcaggcggggaggaggctgccggagggagccctgagcctggcaggtcccctgccctgaggctgtgagcagctagtggtggcttctccagcctttttcagggaactgggaacttaggggactgagctggggagggaggcaggtgggtggtaagagggaaactctggagagcctgcacccaggtactgagtggggagtgtacagacccctgccttgggggttccgggaatgatgcaactggttttactagtgtgcaagtgtgttcatccccaagttctcttttgtcctcacatgcagagttgtgcatgcccctgagtgtgaacaggtttgcctacgttggtgcaagtgtgcatggctggggacttctcacttccccttgcaccccttcctccccaacctgcaataaatccgcttctcctgcagtggatgagtgtgggtgccagtcctcctcaggagaaggggaagggaaggaggccactttgagagggctgaagggagggccttgatttccagccgcaatctggctcctcctggaaaatttcccccacctgcagcgctgggccccaaggcttgccaagactcattgctggaggtagagaggtgtcaaccagagaacagctcccctagacatggcctctggaaaaaggaaatctttggtggccaaagatttcctttctgtggtgagggagaacctctccaaagaggaagcaggcatatgagtgcgcacgccttcacgtgtgtgtatgctgtgtgtgcccgggacccccgtctccaggggtgccccagacccagagattagcctcccacttcggcgcagaaaacaaaagccctttgtgggacccgggcctttgtcttgggtgaggggagatttgcacctagacacttcttgaaaggagacactcagtttcacaagtgagccctcttgcccagcacacacctatggctggctgggcaaggcgctcaggcatgcaaccatgggcaccaggcaatacccatccatcacccatctcactctccccagtcctcaggcagcagcttttccaccccaggaatctctgttccttctctgtctgcctctccacagcccgtgatcccctgcttctggctcctaccactggacagtcattgtggatagagcagcctgctgctctcaggaccagagaagggaaatgacttctccaggcagaggcagatctgagtctagaacccaggcttctaaatttctaggccagtactactgctctcaaaagagattaactgggattaagtgagatgacgcatgtaaagatgctgtgtaaactgtaattcttaataccattatcacgcattactagaatcatttcattatttctgcttcctgggggaaggatgcagaaggagtctgatgctcaacatcccttacctcctttcgttgatggccaaagcaaaggagagtcctgggagcccacaagatccaggcagaaggagatgggtttggggctggccccatcctggcccagcctcttaacctcttcttaccctgaatgtgtgccctatcttttctcccacctccttcctcctaccacccagccctatccattctctccttccctctccagcctgctgtataagtaacatgtgggtcataccttgaacccccctccgcccccatgctctctgtggcctccatgccttcaagacttctgtctgtatctatctcacactgcaccaagcacccactgtgcaccaggcactaagtctctagcctctttctcccttctgctcccatccaagaaagacagtgtataaggaacatctctgtaattgtgtcccctctcatctatgctctttcctgtcttccttgaccaaagctctctttgaggtccaaaaaaggctgccctgggccatatgtgctatggagaggactctcccaaacccccaatagctagtgacagccacttggcctcactaccagaagaagggtggagtcagaaaccaaagtgacctccagagctgtcctcctggcacctgagtgtccttgctctagaggttcaaaggcagcaaggcagtgagctatgagcccagcatggatgtgtctcaggcacctcatccccaccccacctcaccccaacaaactcctctagaagaagccaagaatttctctctatgtctgtttcactttttggattgcatctccccaaaaactaaatgtgaaatccctaccatttctagcctctattgcccagattggagtcagaggtcaaaaaaggattccaagtgatggaactccaggggtggagggaaattggcagttcctggcatctcttgtgtaccagctgctgtgctgggtgccttgcatgcacggacttatctgatcttcctcaaacttcagataggttagggaaggacaaaggcccccagccatgaagggttttgctatttccaaagcttccccttatcgtcccctgtgattatctcccaaccccgtgacaaaggtagagcaaatattgttcttcccattttacagattcagaaaccaaggctaagggactggtctaaagtctcacaggtagtatatggtggagccaacacttgaactcagacctttttacacaaaatcccatgatttttccactgagacaaatcctaggctcctgggaggccctggcagaagccagaacacatggctgggcctttccagcccaacccactgtcttgcagtggacggagagccttggcgagggcagcagggtagagaggacaaagaatgtggggctggtttctgccctttaagagcacccggtcagtcagagaacagagatcacacacaccaaaccagacagaggcagggcagcatggagacaggtagacagacctccaggtccctaagctggggacagagaaggttctgagctgtcccatactcccactttgtgccaaatgactttgcacctgcaaatggtgcttcaatgtcgttttgtatctttaagctgtgatgttgtatatatacaatgcctcccagctagactgtaagccctttggggacaagggctgcttccagttcttggatggcgttctcctatctaccttccttcaactgctctgcatataataagcactcaataaatgctcatttgccaataa

SEQ ID NO: 2303 - DNA, 1849 bp, Homo sapiens
ccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctggtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaacctcca

SEQ ID NO: 2304 - DNA, 902 bp, Homo sapiens
ctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctggtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccaggaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggtccccactccgctgccctggccttgagcatccactgactgtccaagggccactcccaagaagcccccttcacgatccaccctttcaggctaaggagctccctatctaccctcaccccacgacagccccttcaggatttccactggaccttgcccaaatagcaccttag

SEQ ID NO: 2305 - DNA, 5241 bp, Homo sapiens
ccaaaaacccaatcagacaagtggccgtaatctgactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagctgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcacttttatgacccaaatcacaataaaattgtcatttaggataaactggggagaatagactgaacatatggttatattcacagttatttattaacttaaatgttattccaacattagagctaatgttaaaaagatttaaactgtaacgtctaatatttggaataatatattaaagtattagcactgtggttgattttcttgaattatgttgcatcttgtactactaagcttgtgaaaataaacatttggatgttttaaaaggtaaacatta

SEQ ID NO: 2306 - DNA, 702 bp, Homo sapiens
gactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcgttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatga

SEQ ID NO: 2307 - DNA, 991 bp, Homo sapiens
agagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagattt

SEQ ID NO: 2308 - DNA, 1398 bp, Homo sapiens
tcatcgtaggaggttccagctcagtgcccagagacagcccccacatcccaccccatcaggtcagctcaggctggagcaggcatatgagcaacacccctcattccacccccatacacatgcataagcccatccgcctgcgccctgccagtctgaccagcacagtcctggggacaggagcgtggtggaggagctgcaggtgggggccagagaagcctccacagagagcaaaagccagggtcagccagagacaggacaccagaagagacaggagatcagagaccagaggaacagagaagaggccccagagcaaggcaaggaacggccaaggcaccaggacatggatgcagtggagccagggggacgtggctgggccagcatgttggcgtgcaggctttggaaagccatcagcagggcgctgtttgcagagttcctggccacggggctgtatgtgttctttggcgtgggctcagtcatgcgctggcccacagcacttccctccgtgctacagattgccatcaccttcaacctggtcaccgccatggctgtgcaggtcacctggaaggccagcggggcccacgccaaccccgccgtgacgctggccttcctcgtaggctcccacatctctctgccccgtgctgtggcctatgtggctgcccagctggtgggggccacggtgggggctgctctgctttatggggtcatgccgggagacatccgagagacccttgggatcaacgtggtccggaacagtgtctcaactggccaggcggtggcagtggagctgcttctgaccctgcagctggtgctctgtgtcttcgcttccaccgacagccgtcagacatcaggctccccggccaccatgattgggatctctgtggcactgggccacctcattgggatccacttcactggctgctccatgaatccagcccgctccttcggccctgccatcatcattgggaagttcacagtccactgggtcttctgggtggggcccctgatgggagccctcctggcctcactgatctacaacttcgtcctgttccccgacaccaagaccctggcgcagcggctggctatcctcacaggcaccgtagaggtggggacaggggcaggggcaggggcggagcccctgaagaaggaatcccagccgggttcgggagccgtggagatggagagtgtgtgaaacagcctacgcctggccgcgcccttgggcttcctgccttgcaggacctgcctggaggttctccctgggggtggcgggagggggaggcttgaccttttgtcctgaccaggtgggctggaggggacaagccctatccctggcattacgtttctaggtagaatctgggagtgaatttgtcccattccctctctgtagggcttccccacctctcg

SEQ ID NO: 2309 - DNA, 1256 bp, Homo sapiens
ggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgaca

SEQ ID NO: 2310 - DNA, 1067 bp, Homo sapiens
ggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgac

SEQ ID NO: 2311 - DNA, 677 bp, Homo sapiens
gttgcccttggagctggcctcctggctgtgggggagagttggatgggctgggccacattcactgatcagggagaggaggggctggagccatccgggccctggaaaaccagccatacacgagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggca

SEQ ID NO: 2312 - DNA, 1062 bp, Homo sapiens
gagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgactcctctgctcaacctgtcttggcccgaggtggatgag

SEQ ID NO: 2313 - DNA, 1108 bp, Homo sapiens
aggcagacttgagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgaca

SEQ ID NO: 2314 - DNA, 675 bp, Homo sapiens
gagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccact

SEQ ID NO: 2315 - DNA, 629 bp, Homo sapiens
ctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgaca

SEQ ID NO: 2316 - DNA, 1668 bp, Homo sapiens
tggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgactcctctgctcaacctgtcttggcccgaggtggatgagggtgctgtcctgggcatcagccccctcagcaggcctctgcctcttgcctgcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacagcagtacccccacttcctgggggcctcctgtggttgggcttccctcctgggttcttacaggagctccagggctatgtcttagcccaaggtgtagaggtgaggcacctcaagtctttcatgccctgggaactggggtgccccagggggagaatggggaagagatgacctgcgccctcagtagga

SEQ ID NO: 2317 - DNA, 1270 bp, Homo sapiens
cttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgactcctctgctcaacctgtctt

SEQ ID NO: 2318 - DNA, 989 bp, Homo sapiens
gatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacagcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtc

SEQ ID NO: 2319 - DNA, 1359 bp, Homo sapiens
aaaggggcagagcccatagtgtgatcagcaggtcctgtccctaggagataagagtatcttgcacagcaggtgcaggtttcccagcagctcaggcaagagtccgatgtttgtgccatctgatcctgatgtctggagagatagccatgtgtgagcctgaatttggcaatgacaaggccagggagccgagcgtgggtggcaggtggcgagtgtcctggtacgaacggtttgtgcagccatgtctggtcgaactgctgggctctgctctcttcatcttcatcgggtgcctgtcggtcattgagaatgggacggacactgggctgctgcagccggccctggcccacgggctggctttggggctcgtgattgccacgctggggaatatcagtggtggacacttcaaccctgcggtgtccctggcagccatgctgatcggaggcctcaacctggtgatgctcctcccgtactgggtctcacagctgctcggggggatgctcggggctgccttggccaaggcggtgagtcctgaggagaggttctggaatgcatctggggcggcctttgtgacagtccaggagcaggggcaggtggcaggggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttcttgcttgattgctttgttgggggcctggccacttccttgcttctcaagctgacaattctcactttgcaataaatagtccagtgtttccttccacgtgctca

SEQ ID NO: 2320 - DNA, 3034 bp, Homo sapiens
actgtgatttggcaacacaactggcacatctcttttctcatctcttgaaaaaaaccaacagagaaaaaagtaccttgagaataaaggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatctttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgacaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttg

SEQ ID NO: 2321 - DNA, 2803 bp, Homo sapiens
ccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatctttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgacaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttg

SEQ ID NO: 2322 - DNA, 2358 bp, Homo sapiens
cccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggcccgcgcggggcgaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccgcccgcctgccaggagacaatgctttggacatgttccagaagcatcgagagaaggaactgaaagacagacagcagatctactgctgggccacctggaaggaagggttacccctgaccatcgctgcagaccgtaaggatgatctacctccaaatatgagattccatgaggagaagaggctggactttgaatggacactgaaggcaggggctctggagatggccctcaaacgtgtttacaccctcctgagctcctggaactgcctagaagactttgatcagatcttctggggccagaagagtgccctggctgagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcagaatggttccctgtttgaagctgacttcatccttctggatggaattccagccaacgtgatccgaggagagaagcaatacctggctgcccccctcgttatgctgaagatggagcccaatgggaagctgcagcccatggtcatccagattcagcctcccaaccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaagttcctgatcccccatatccgctacaccatggaaatcaacacccgggcccggacccaactcatctcagatggaggaatttttgataaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtatgtggaggggatcgtccacctcttctaccaaagggatgacatagtgaagggggaccctgagctgcaggcctggtgtcgggagatcacggaggtggggctgtgccaggcccaggaccgaggtttccctgtctccttccagtcccagagtcaactctgccatttcctcaccatgtgcgtcttcacgtgcactgcccagcatgccgccatcaaccagggccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactga

SEQ ID NO: 2323 - DNA, 2503 bp, Homo sapiens
gcccagacacctgctcactcaccaccagctgggctccgcctgggcctgcccggcacccaccccggccaccaagggcagcagcttttccagaatttggctggcaggcctagtcaccccacctcgccacctcaccactgcacctcggaggccagccctgtccactccactctgtgcctggcttctcttgcctgccttgggccttcgtgtggcccctccacggtgtctgggactgagtgcccctcttgcctcctgaagagcagccatggccacctacaaagtcagggtggccacaggcaccgacctcttgtcgggaacacgggactccatctcactgaccattgtggggacacaaggagagagccataagcagctgctgaaccactttgggagagactttgcaactggggcggtgggccagtacaccgtgcagtgccctcaggacctgggtgagctcatcatcatccgcctgcacaaagagcggtacgccttcttccccaaggacccttggtactgcaactatgtgcagatctgtgcccccaacggccgtatctaccacttccccgcctaccagtggatggatggctacgagaccctggcactccgggaggccacaggaaagacaacagcagatgactcgctccccgtcctcctggagcacagaaaagaggagatcagagccaagcaggacttctaccactggcgagtctttcttcctggcctgcccagctatgtgcacattcccagttaccgccctccggtgcggaggcatcgcaaccccaaccggcctgagtggaatggctatattccgggattcccaattctcatcaactttaaggccaccaagttcctgaacttaaatctccgctactccttcctcaagacggcctccttcttcgtccgcctggggcccatggcactggctttcaaagtccgcggcctgttggactgcaaacattcgtggaagaggctgaaggacattaggaaaattttccctggcaagaaatctgtcgtctccgagtacgtggccgagcactgggcagaggacaccttctttgggtaccagtacctcaacggcgtcaaccccggcctgatccgccgctgcacgcggatcccagacaagttccccgtcacagacgacatggtggctccgttcctgggcgagggaacgtgcttgcaagcggagctggagaaggggaacatttacctggccgactaccgcatcatggagggcatccccaccgtggagctcagcggccggaagcagcaccactgcgcccccctctgcctgctgcactttggacccgagggcaagatgatgcccatcgccatccagctcagccagacccctgggccagattgccccatcttcctgcccagtgattctgagtgggactggctgctagccaagacgtgggtacgctatgcggagttctacagccacgaggccatcgcccacctgctggagacacacctcattgctgaggccttctgcctggccttgctgaggaacctgcccatgtgccaccccctctacaagctcctcatcccccatacccgatacaccgtccagatcaacagcattggccgggccgttctcctcaatgagggggggctctctgccaagggcatgtccctgggcgtggaaggctttgctggggtgatggtacgggctctgtcggagctcacctatgacagcctctacctccccaatgactttgtggagcgtggggtccaggacctgcctggatattactaccgcgatgacagcttggcggtgtggaatgcactggagaagtatgtgacggagatcatcacctattattacccgagtgacgcagccgtggagggtgatccggaattgcagtcttgggtgcaggaaatatttaaagagtgcctcctggggcgggagagctcaggcttccctaggtgcttgcgaaccgtgcctgagctgatccgatatgtcactatagtcatctacacctgctctgccaagcacgctgctgtcaacacaggccagatggagttcaccgcctggatgcccaacttcccagcgtccatgcggaatccaccgattcagactaaggggctgaccactctggagaccttcatggacacgttgccggatgtgaagaccacgtgcatcacgctgctggtgctctggaccctcagccgagagcctgacgacaggcggcccctgggacacttcccggacattcacttcgtggaggaggccccgcggaggagcatagaggcgttccgccagcgcctgaaccagatctcacacgacatccgccagcgcaacaagtgccttcccatcccctactactacctggacccggtgctgattgagaacagcatttctatttaggagcgcgcttcccgtctctcctctccccattctgtgccctactattttcaacaaaacaaaacaaacaagcaaaaaacacaaaaacctcagagaccaaaacaccaaacaaacaaaaaaacaaaaaaccttcctttc

SEQ ID NO: 2324 - DNA, 2682 bp, Homo sapiens
tctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggccaaactatatgacctccctgtggatgagcgatttctggaagacaagagagttgactttgaggtttcgctggccaaggggctggccgacctcgctatcaaagactctctaaatgttctgacttgctggaaggatctagatgacttcaaccggattttctggtgtggtcagagcaagctggctgagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaagcttataattccccacctgcgatacaccctggaaattaacgtccgggccaggactgggctggtctctgacatgggaattttcgaccagataatgagcactggtgggggaggccacgtgcagctgctcaagcaagctggagccttcctaacctacagctccttctgtccccctgatgacttggccgaccgggggctcctgggagtgaagtcttccttctatgcccaagatgcgctgcggctctgggaaatcatctatcggtatgtggaaggaatcgtgagtctccactataagacagacgtggctgtgaaagacgacccagagctgcagacctggtgtcgagagatcactgaaatcgggctgcaaggggcccaggaccgagggtttcctgtctctttacaggctcgggaccaggtttgccactttgtcaccatgtgtatcttcacctgcaccggccaacacgcctctgtgcacctgggccagctggactggtactcttgggtgcctaatgcaccctgcacgatgcggctgcccccgccaaccaccaaggatgcaacgctggagacagtgatggcgacactgcccaacttccaccaggcttctctccagatgtccatcacttggcagctgggcagacgccagcccgttatggtggctgtgggccagcatgaggaggagtatttttcgggccctgagcctaaggctgtgctgaagaagttcagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgtggttatagccctgccctcccaagtcccaccctcttcccatgtcccaccctccctagaggggcaccttttcatggtctctgcacccagtgaacacattttactctagaggcatcacctgggaccttactcctctttccttccttcctcctttcctatcttccttcctctctctcttcctctttcttcattcagatctatatggcaaatagccacaattatataaatcatttcaagactagaatagggggatataatacatattactccacaccttttatgaatcaaatatgatttttttgttgttgttaagacagagtctcactttgacacccaggctggagtgcagtggtgccatcaccacggctcactgcagcctcagcgtcctgggctcaaatgatcctcccacctcagcctcctgagtagctgggactacaggctcatgccatcatgcccagctaatatttttttattttcgtggagacggggcctcactatgttgcctaggctggaaataggattttgaacccaaattgagtttaacaataataaaaagttgttttacgctaaagatggaaaagaactaggactgaactattttaaataaaatattggcaaaagaa

SEQ ID NO: 2325 - DNA, 2200 bp, Homo sapiens
ttctgcaggcaacagggaggcagcggcttttatgctcaaaaggaatgagtcccagtggctggcacagagaagaaggagcgaaacatctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggccaaactatatgacctccctgtggatgagcgatttctggaagacaagagagttgactttgaggtttcgctggccaaggggctggccgacctcgctatcaaagactctctaaatgttctgacttgctggaaggatctagatgacttcaaccggattttctggtgtggtcagagcaagctggctgagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaagcttataattccccacctgcgatacaccctggaaattaacgtccgggccaggactgggctggtctctgacatgggaattttcgaccagataatgagcactggtgggggaggccacgtgcagctgctcaagcaagctggagccttcctaacctacagctccttctgtccccctgatgacttggccgaccgggggctcctgggagtgaagtcttccttctatgcccaagatgcgctgcggctctgggaaatcatctatcggtatgtggaaggaatcgtgagtctccactataagacagacgtggctgtgaaagacgacccagagctgcagacctggtgtcgagagatcactgaaatcgggctgcaaggggcccaggaccgagggtttcctgtctctttacaggctcgggaccaggtttgccactttgtcaccatgtgtatcttcacctgcaccggccaacacgcctctgtgcacctgggccagctggactggtactcttgggtgcctaatgcaccctgcacgatgcggctgcccccgccaaccaccaaggatgcaacgctggagacagtgatggcgacactgcccaacttccaccaggcttctctccagatgtccatcacttggcagctgggcagacgccagcccgttatggtggctgtgggccagcatgaggaggagtatttttcgggccctgagcctaaggctgtgctgaagaagttcagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgtggttatagccctgccctcccaagtcccaccctcttcccatgtcccaccctccc

SEQ ID NO: 2326 - DNA, 2784 bp, Homo sapiens
ttctgcaggcaacagggaggcagcggcttttatgctcaaaaggaatgagtcccagtggctggcacagagaagaaggagcgaaacatctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggccaaactatatgacctccctgtggatgagcgatttctggaagacaagagagttgactttgaggtttcgctggccaaggggctggccgacctcgctatcaaagactctctaaatgttctgacttgctggaaggatctagatgacttcaaccggattttctggtgtggtcagagcaagctggctgagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaagcttataattccccacctgcgatacaccctggaaattaacgtccgggccaggactgggctggtctctgacatgggaattttcgaccagataatgagcactggtgggggaggccacgtgcagctgctcaagcaagctggagccttcctaacctacagctccttctgtccccctgatgacttggccgaccgggggctcctgggagtgaagtcttccttctatgcccaagatgcgctgcggctctgggaaatcatctatcggtatgtggaaggaatcgtgagtctccactataagacagacgtggctgtgaaagacgacccagagctgcagacctggtgtcgagagatcactgaaatcgggctgcaaggggcccaggaccgagggtttcctgtctctttacaggctcgggaccaggtttgccactttgtcaccatgtgtatcttcacctgcaccggccaacacgcctctgtgcacctgggccagctggactggtactcttgggtgcctaatgcaccctgcacgatgcggctgcccccgccaaccaccaaggatgcaacgctggagacagtgatggcgacactgcccaacttccaccaggcttctctccagatgtccatcacttggcagctgggcagacgccagcccgttatggtggctgtgggccagcatgaggaggagtatttttcgggccctgagcctaaggctgtgctgaagaagttcagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgtggttatagccctgccctcccaagtcccaccctcttcccatgtcccaccctccctagaggggcaccttttcatggtctctgcacccagtgaacacattttactctagaggcatcacctgggaccttactcctctttccttccttcctcctttcctatcttccttcctctctctcttcctctttcttcattcagatctatatggcaaatagccacaattatataaatcatttcaagactagaatagggggatataatacatattactccacaccttttatgaatcaaatatgatttttttgttgttgttaagacagagtctcactttgacacccaggctggagtgcagtggtgccatcaccacggctcactgcagcctcagcgtcctgggctcaaatgatcctcccacctcagcctcctgagtagctgggactacaggctcatgccatcatgcccagctaatatttttttattttcgtggagacggggcctcactatgttgcctaggctggaaataggattttgaacccaaattgagtttaacaataataaaaagttgttttacgctaaagatggaaaagaactaggactgaactattttaaataaaatattggcaaaagaatatagagcatcaaaaaa

SEQ ID NO: 2327 - DNA, 897 bp, Homo sapiens
aatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgtttt

SEQ ID NO: 2328 - DNA, 3396 bp, Homo sapiens
ggaaccggccgcgcggggccgctgcgggctatgggcttctctgagaggttcctccccagtccctagtggcccagatcccggacacctgggctcccgcccaggatcctgcaggcccagggcggtcctggagcggaaagaatgccacgcggggcattcagaccctgtttgccggcgctgtatttcgctttcctgacctgccctactccagagcagagaatgagtggaacccaggctcctgatatccatctgggtgagccagccagagggaccggctgtgtcagaggcaagcaaacaagtattagagtgcaagactgtgggcggagagaggaagcccgagccgccagcagggagcttcggagagagaaagcccaggaacatcccagagagagctgggcccatcctcagccctacccagccccgcagcccctagccctccgcccagaaacccagccctgtccggcgtgccgctcttctcctccaggccggctgctgctgcggccagcgttgccggggcatcccttcctccttcccatcatggcagtgtaccgcctgtgtgtgaccactggtccctacctgagggccggcacactggacaacatctctgtcacactggtgggcacgtgtggtgaaagccccaagcagcggctagatcgaatgggcagggacttcgcccctggatcggtacagaagtacaaggtgcgttgcacagcggagctgggtgagctcttgctgctgcgtgtacacaaggagcgctacgctttcttccgcaaggactcttggtactgtagccgcatctgtgtcaccgaaccggatggtagtgtatcccacttcccctgctatcagtggattgaaggctactgcaccgtggagctgaggccaggaacagcaagaactatttgtcaggactctcttcccctcctcctggatcacaggacacgggagctccgggcccgacaagaatgctaccgctggaagatctatgcccctggcttcccctgcatggtagacgtcaacagctttcaggagatggagtcagacaagaaatttgccttgacaaagacgacaacttgtgtagaccagggtgacagcagtgggaatcggtacctgcccggcttccccatgaaaattgacatcccatccctgatgtacatggagcccaatgttcgatactcagccaccaagacgatctcgctgctcttcaatgccatccctgcgtccttgggaatgaagcttcgagggctgttggatcgcaagggctcctggaagaagctggatgacatgcagaacatcttctggtgccataagaccttcacgacaaagtatgtcacagagcactggtgtgaagatcacttctttgggtaccagtacctgaatggtgtcaatcccgtcatgctccactgcatctctagcttgcccagcaagctgcctgtcaccaatgacatggtggcccccttgctgggacaggacacatgcctgcagacagagctagagagggggaacatcttcctagcggactactggatcctggcggaggcccccacccactgcctaaacggccgccagcagtacgtggccgccccactgtgcctgctgtggctcagcccccagggggcgctggtgcccttggccatccagctcagccagacccccgggcctgacagccccatcttcctgcccactgactccgaatgggactggctgctggccaagacgtgggtgcgcaactctgagttcctggtgcacgaaaacaacacgcactttctgtgcacgcatttgctgtgcgaggccttcgccatggccacgctgcgccagctgccgctctgccaccccatctacaagctcctactcccccacactcgatacacgctgcaggtgaacaccatcgcgagggccacgctgctcaaccccgagggcctcgtggaccaggtcacgtccatcgggaggcaaggcctcatctacctcatgagcacgggcctggcccacttcacctacaccaatttctgccttccggacagcctgcgggcccgcggcgtcctggctatccccaactaccactaccgagacgacggcctgaagatctgggcggccattgagagctttgtctcagaaatcgtgggctactattatcccagtgacgcatctgtgcagcaggattcggagctgcaggcctggactggcgagatttttgctcaggcgttcctgggccgggaaagctcaggtttcccaagccggctgtgcaccccaggagagatggtgaagttcctcactgcaatcatcttcaattgctctgcccagcacgctgctgtcaacagtgggcagcatgactttggggcctggatgcccaatgctccatcatccatgaggcagcccccaccccagaccaaggggaccaccaccctgaagacttacctagacaccctccctgaagtgaacatcagctgtaacaacctcctcctcttctggttggttagccaagaacccaaggaccagaggcccctgggcacctacccagatgagcacttcacagaggaggccccgaggcggagcatcgccgccttccagagccgcctggcccagatctcaagggacatccaggagcggaaccagggtctggcactgccctacacctacctggaccctcccctcattgagaacagcgtctccatctaaccacccccaaataccacccaagaagaaagaaaggtccaagcatgaggaggaccagttcctcaggtcctccagacccttccatcctccctgttctcagttcacctgaaccttctcttctgcacatggagacttttgcagccaagatggctctgacatcatacaaactgggccctgagctgtgagagaccagcacagcagcgtccaggttaaaagccgctgaccaaagtccaatgcacaatagcccctccgaaaggaaggaaccgcttcacttcttgccccacttggggcagcctcttgttccagcctcttggaatgcccagcttgggtttctgagcttttctccctcatcctccccaatccccaaactccttctcctaccatgcctttctacgttctctttcttccaagcctagagccaccagcccagcttccttctctggaaaagcctggaaactgggcacagaaggactgtgtgcctgggtctaacatgtggtcccctttgtccctagcacctttaaggggaggggaagaattggagggcagcttgcctggacccctaacggctgttctcaggaacaggttcccaggcctggggtgtttgtggagatctgtctttctccaaagatttcatccaactcccctttcatcccactccctttcatcccatttttttctttctgtccttgagcccagtgagttcaataaaaaccaaaatatttggctctc

SEQ ID NO: 2329 - DNA, 3362 bp, Homo sapiens
gcaggtgccctgtgctcatctctgcctgggaatggggaggaacagatcttgggggacattggggagtgggcggacaagcactccagggcatcagtccgggccgctgaccaggcggagggcagtgtcccaattatacaggcgttacctccttttctccatctcagcatctgatccctccctccgcagtggaacccaggctcctgatatccatctgggtgagccagccagagggaccggctgtgtcagaggcaagcaaacaagtattagagtgcaagactgtgggcggagagaggaagcccgagccgccagcagggagcttcggagagagaaagcccaggaacatcccagagagagctgggcccatcctcagccctacccagccccgcagcccctagccctccgcccagaaacccagccctgtccggcgtgccgctcttctcctccaggccggctgctgctgcggccagcgttgccggggcatcccttcctccttcccatcatggcagtgtaccgcctgtgtgtgaccactggtccctacctgagggccggcacactggacaacatctctgtcacactggtgggcacgtgtggtgaaagccccaagcagcggctagatcgaatgggcagggacttcgcccctggatcggtacagaagtacaaggtgcgttgcacagcggagctgggtgagctcttgctgctgcgtgtacacaaggagcgctacgctttcttccgcaaggactcttggtactgtagccgcatctgtgtcaccgaaccggatggtagtgtatcccacttcccctgctatcagtggattgaaggctactgcaccgtggagctgaggccaggaacagcaagaactatttgtcaggactctcttcccctcctcctggatcacaggacacgggagctccgggcccgacaagaatgctaccgctggaagatctatgcccctggcttcccctgcatggtagacgtcaacagctttcaggagatggagtcagacaagaaatttgccttgacaaagacgacaacttgtgtagaccagggtgacagcagtgggaatcggtacctgcccggcttccccatgaaaattgacatcccatccctgatgtacatggagcccaatgttcgatactcagccaccaagacgatctcgctgctcttcaatgccatccctgcgtccttgggaatgaagcttcgagggctgttggatcgcaagggctcctggaagaagctggatgacatgcagaacatcttctggtgccataagaccttcacgacaaagtatgtcacagagcactggtgtgaagatcacttctttgggtaccagtacctgaatggtgtcaatcccgtcatgctccactgcatctctagcttgcccagcaagctgcctgtcaccaatgacatggtggcccccttgctgggacaggacacatgcctgcagacagagctagagagggggaacatcttcctagcggactactggatcctggcggaggcccccacccactgcctaaacggccgccagcagtacgtggccgccccactgtgcctgctgtggctcagcccccagggggcgctggtgcccttggccatccagctcagccagacccccgggcctgacagccccatcttcctgcccactgactccgaatgggactggctgctggccaagacgtgggtgcgcaactctgagttcctggtgcacgaaaacaacacgcactttctgtgcacgcatttgctgtgcgaggccttcgccatggccacgctgcgccagctgccgctctgccaccccatctacaagctcctactcccccacactcgatacacgctgcaggtgaacaccatcgcgagggccacgctgctcaaccccgagggcctcgtggaccaggtcacgtccatcgggaggcaaggcctcatctacctcatgagcacgggcctggcccacttcacctacaccaatttctgccttccggacagcctgcgggcccgcggcgtcctggctatccccaactaccactaccgagacgacggcctgaagatctgggcggccattgagagctttgtctcagaaatcgtgggctactattatcccagtgacgcatctgtgcagcaggattcggagctgcaggcctggactggcgagatttttgctcaggcgttcctgggccgggaaagctcaggtttcccaagccggctgtgcaccccaggagagatggtgaagttcctcactgcaatcatcttcaattgctctgcccagcacgctgctgtcaacagtgggcagcatgactttggggcctggatgcccaatgctccatcatccatgaggcagcccccaccccagaccaaggggaccaccaccctgaagacttacctagacaccctccctgaagtgaacatcagctgtaacaacctcctcctcttctggttggttagccaagaacccaaggaccagaggcccctgggcacctacccagatgagcacttcacagaggaggccccgaggcggagcatcgccgccttccagagccgcctggcccagatctcaagggacatccaggagcggaaccagggtctggcactgccctacacctacctggaccctcccctcattgagaacagcgtctccatctaaccacccccaaataccacccaagaagaaagaaaggtccaagcatgaggaggaccagttcctcaggtcctccagacccttccatcctccctgttctcagttcacctgaaccttctcttctgcacatggagacttttgcagccaagatggctctgacatcatacaaactgggccctgagctgtgagagaccagcacagcagcgtccaggttaaaagccgctgaccaaagtccaatgcacaatagcccctccgaaaggaaggaaccgcttcacttcttgccccacttggggcagcctcttgttccagcctcttggaatgcccagcttgggtttctgagcttttctccctcatcctccccaatccccaaactccttctcctaccatgcctttctacgttctctttcttccaagcctagagccaccagcccagcttccttctctggaaaagcctggaaactgggcacagaaggactgtgtgcctgggtctaacatgtggtcccctttgtccctagcacctttaaggggaggggaagaattggagggcagcttgcctggacccctaacggctgttctcaggaacaggttcccaggcctggggtgtttgtggagatctgtctttctccaaagatttcatccaactcccctttcatcccactccctttcatcccatttttttctttctgtccttgagcccagtgagttcaataaaaaccaaaatatttggctctca

SEQ ID NO: 2330 - DNA, 3232 bp, Homo sapiens
agtgcaactctccactgtttagtgattcacacggatgattcacacgtaggaatgcagtggaacccaggctcctgatatccatctgggtgagccagccagagggaccggctgtgtcagaggcaagcaaacaagtattagagtgcaagactgtgggcggagagaggaagcccgagccgccagcagggagcttcggagagagaaagcccaggaacatcccagagagagctgggcccatcctcagccctacccagccccgcagcccctagccctccgcccagaaacccagccctgtccggcgtgccgctcttctcctccaggccggctgctgctgcggccagcgttgccggggcatcccttcctccttcccatcatggcagtgtaccgcctgtgtgtgaccactggtccctacctgagggccggcacactggacaacatctctgtcacactggtgggcacgtgtggtgaaagccccaagcagcggctagatcgaatgggcagggacttcgcccctggatcggtacagaagtacaaggtgcgttgcacagcggagctgggtgagctcttgctgctgcgtgtacacaaggagcgctacgctttcttccgcaaggactcttggtactgtagccgcatctgtgtcaccgaaccggatggtagtgtatcccacttcccctgctatcagtggattgaaggctactgcaccgtggagctgaggccaggaacagcaagaactatttgtcaggactctcttcccctcctcctggatcacaggacacgggagctccgggcccgacaagaatgctaccgctggaagatctatgcccctggcttcccctgcatggtagacgtcaacagctttcaggagatggagtcagacaagaaatttgccttgacaaagacgacaacttgtgtagaccagggtgacagcagtgggaatcggtacctgcccggcttccccatgaaaattgacatcccatccctgatgtacatggagcccaatgttcgatactcagccaccaagacgatctcgctgctcttcaatgccatccctgcgtccttgggaatgaagcttcgagggctgttggatcgcaagggctcctggaagaagctggatgacatgcagaacatcttctggtgccataagaccttcacgacaaagtatgtcacagagcactggtgtgaagatcacttctttgggtaccagtacctgaatggtgtcaatcccgtcatgctccactgcatctctagcttgcccagcaagctgcctgtcaccaatgacatggtggcccccttgctgggacaggacacatgcctgcagacagagctagagagggggaacatcttcctagcggactactggatcctggcggaggcccccacccactgcctaaacggccgccagcagtacgtggccgccccactgtgcctgctgtggctcagcccccagggggcgctggtgcccttggccatccagctcagccagacccccgggcctgacagccccatcttcctgcccactgactccgaatgggactggctgctggccaagacgtgggtgcgcaactctgagttcctggtgcacgaaaacaacacgcactttctgtgcacgcatttgctgtgcgaggccttcgccatggccacgctgcgccagctgccgctctgccaccccatctacaagctcctactcccccacactcgatacacgctgcaggtgaacaccatcgcgagggccacgctgctcaaccccgagggcctcgtggaccaggtcacgtccatcgggaggcaaggcctcatctacctcatgagcacgggcctggcccacttcacctacaccaatttctgccttccggacagcctgcgggcccgcggcgtcctggctatccccaactaccactaccgagacgacggcctgaagatctgggcggccattgagagctttgtctcagaaatcgtgggctactattatcccagtgacgcatctgtgcagcaggattcggagctgcaggcctggactggcgagatttttgctcaggcgttcctgggccgggaaagctcaggtttcccaagccggctgtgcaccccaggagagatggtgaagttcctcactgcaatcatcttcaattgctctgcccagcacgctgctgtcaacagtgggcagcatgactttggggcctggatgcccaatgctccatcatccatgaggcagcccccaccccagaccaaggggaccaccaccctgaagacttacctagacaccctccctgaagtgaacatcagctgtaacaacctcctcctcttctggttggttagccaagaacccaaggaccagaggcccctgggcacctacccagatgagcacttcacagaggaggccccgaggcggagcatcgccgccttccagagccgcctggcccagatctcaagggacatccaggagcggaaccagggtctggcactgccctacacctacctggaccctcccctcattgagaacagcgtctccatctaaccacccccaaataccacccaagaagaaagaaaggtccaagcatgaggaggaccagttcctcaggtcctccagacccttccatcctccctgttctcagttcacctgaaccttctcttctgcacatggagacttttgcagccaagatggctctgacatcatacaaactgggccctgagctgtgagagaccagcacagcagcgtccaggttaaaagccgctgaccaaagtccaatgcacaatagcccctccgaaaggaaggaaccgcttcacttcttgccccacttggggcagcctcttgttccagcctcttggaatgcccagcttgggtttctgagcttttctccctcatcctccccaatccccaaactccttctcctaccatgcctttctacgttctctttcttccaagcctagagccaccagcccagcttccttctctggaaaagcctggaaactgggcacagaaggactgtgtgcctgggtctaacatgtggtcccctttgtccctagcacctttaaggggaggggaagaattggagggcagcttgcctggacccctaacggctgttctcaggaacaggttcccaggcctggggtgtttgtggagatctgtctttctccaaagatttcatccaactcccctttcatcccactccctttcatcccatttttttctttctgtccttgagcccagtgagttcaataaaaaccaaaatatttggctctc

SEQ ID NO: 2331 - DNA, 1912 bp, Homo sapiens
atggaatccactaagaaggggcgagaccagtgaggattcaactaaagggagcgagaaggggcggggacccgggaggaggaagtggagtggccaccgaggaagaggggagtggtcggggtggggcacaggatggtggagagactgtcaacaacttttaatgagctcccttggcgtcctagcctagcccccaggcactgggagcattgcagaaagagaaagatactgtccctgtcctctaggtgtttccagtctagttggggagacaaaacaaatacacattaaatagataacaaacaactccaacttgtaaggctataatagatacgtgtagagcatatgtataatgcactgtattcaggaattccaagcagttcgaacgtcatgacccctcagaagttgacccagaagctggtgaaggaggcccagagaaagatacagggtgaggcacagtgaatctgctggaccagcttcaagaacaatatgtcagcctatccactgccacctcccacagctccagactcgtgggtgcttcctggatgtgaccagccatagaatttatcaccctggcaaggaccctggtacttggaagcttggagaaagtgattcagggctcttacccgcagtgggcaggactgctgacggctcccagctggattttcctgcaactgccctcaatgaagcaagctgttccacccaaggttgatgcaggacaaagagggtctcgctctgtcgcccaggctggagtgcagtggcgagtcactacagcctcgacctctccggctcaagccatcctcccgtctctgtctcccaaagtgctgggattacagcggtgagccactgtgcctggcttactgcctcatcttgttccctgaggttctagacctctagggtgttgtccggaaagaacagggccatgtggaagtcagcaaagagagaggccgattgaacagcaggctcttctcaggcatcgccaagtgactgattaggattggccaccagggggtgccatggagccacagtctatgaagggacagaagaggccttttgggggaccctggaggttgaaggtgctgggaggccctccttggcttaggaggacacttccaaagctggggcgccccaaggaggcaccagtggccagaatgtccacgcagagcacccaccccctgaaacctgaggccccacgtctgccacctgggatccccgagtccccgagctgtcagcggcgccacacactccctgccagtgagtttcgctgcctcaccccggaggacgctgtcagcgcctttgagatcgagcgtgaagccttcatctccgtcttgggcgtctgccccctgtacctggatgagatccggcacttcctgaccctatgtccagagctgtccctgggctggttcgaggagggctgccttgtggccttcatcatcggctcgctctgggacaaggagagactcatgcaggagtcactgacgctgcacaggtctgggggccacatagcccacctgcatgtgctggccgtgcaccgcgccttccggcagcagggcaggggccccatcctgctgtggcgctacctgcaccacctgggcagccagccggccgtgcgccgggccgcgctcatgtgcgaggacgcgctggtacccttctatgagaggttcagcttccacgccgtgggcccctgcgccatcaccgtgggctccctcaccttcatggagctccactgctccctgcggggccaccccttcctgcgcaggaacagcggctgctgaactgggctgcccacctggctgccaacatgatccccgtctctgccctgggctcctcttagctcagctgagcatggagacagcagtttccagagagtggagagagcagggctaaataaagaggagataaggtggcttctcacggcctg

SEQ ID NO: 2332 - DNA, 1025 bp, Homo sapiens
cgagaggtggggtggggggattacaaacctctaacagcaccacaggctgcccggggaacatctgctactacagccttgcagcccggagtcccggattttactggttcccgtgcctgcggacaggcccccagggctagcggctttgtggagggaacactgggtatcctctccacagtccaggtgctgggaggccctccttggcttaggaggacacttccaaagctggggcgccccaaggaggcaccagtggccagaatgtccacgcagagcacccaccccctgaaacctgaggccccacgtctgccacctgggatccccgagtccccgagctgtcagcggcgccacacactccctgccagtgagtttcgctgcctcaccccggaggacgctgtcagcgcctttgagatcgagcgtgaagccttcatctccgtcttgggcgtctgccccctgtacctggatgagatccggcacttcctgaccctatgtccagagctgtccctgggctggttcgaggagggctgccttgtggccttcatcatcggctcgctctgggacaaggagagactcatgcaggagtcactgacgctgcacaggtctgggggccacatagcccacctgcatgtgctggccgtgcaccgcgccttccggcagcagggcaggggccccatcctgctgtggcgctacctgcaccacctgggcagccagccggccgtgcgccgggccgcgctcatgtgcgaggacgcgctggtacccttctatgagaggttcagcttccacgccgtgggcccctgcgccatcaccgtgggctccctcaccttcatggagctccactgctccctgcggggccaccccttcctgcgcaggaacagcggctgctgaactgggctgcccacctggctgccaacatgatccccgtctctgccctgggctcctcttagctcagctgagcatggagacagcagtttccagagagtggagagagcagggctaaataaagaggagataaggtggcttctcacggcctg

SEQ ID NO: 2333 - DNA, 3845 bp, Homo sapiens
agcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 2334 - DNA, 4038 bp, Homo sapiens
gaagcggcagcggttcctgtcaagggggcagcaggtccagagctgctggtgctcccgttccccagaccctacccctatccccagtggagccggagtgcgggcgcgccccaccaccgccctcaccatgataacttgatttaaaacatcgtccagtgtacctgagagatggcagaatgtaatttggtggcaatcctaataagttctattgacaaccctttagataagaacttggataatggggggaattcatgcttggactttaggccactgaacagcttttctcagcctcaggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 2335 - DNA, 1709 bp, Homo sapiens
gacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatg

SEQ ID NO: 2336 - DNA, 2238 bp, Homo sapiens
gaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatg

SEQ ID NO: 2337 - DNA, 2512 bp, Homo sapiens
agcactgcctggaagtgtggggtgagagctcctcctaggacacccctttccccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggagccttggtgttcacttctccaaagtccggtctctgacccttgactcatgggagccagaactagtgaagctcatgtgtgagctgggaaatgtcatcatcaaccagatctatgaggcccgcgtggaggccatggcagtgaagaaaccagggcccagctgctcccggcaggagaaggaggcctggattcacgctaaatacgtggagaagaagttcctgaccaagctgcctgagattcgagggcgaagaggtggccgggggcgcccaagggggcagcctcctgtgcccccaaagccttccatcaggccccggccagggagcttgagatccaagccagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcc

SEQ ID NO: 2338 - DNA, 7160 bp, Homo sapiens
cgtttccctgcggccagcgctctacttggggcgggaggaagaggggcgggactggggcctgactagtcgtcgccgtcttcgcggctgctatgaccagcgggcgaggcgcccttcgcagctccgcgcaacgctagtcgcggccgtgcgcccgccgtagccgtctgcgtcccagcgcggccgctcccgcggccccctcggctttgccagcgccgcctgcgaggcggaggcaggatgaagatgactgtggatttcgaggagtgtctgaaggactcgccccgcttcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaaatcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggctttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggttacttgaatgtcacaaaattatgccttcatcaaaactttaaaggaaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgctttttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaacaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaagtacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggatcatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggcttagttctttca

SEQ ID NO: 2339 - DNA, 4942 bp, Homo sapiens
acttttcgctttctcagtgttttcaggaagtgtgtgtgttggccacggctgcaggaggtgggggagacacaaagcaggaagcctccgggagaccagagctgggtgcagacatacacacacacatacacacagacacacagagtcacacacactcacacacactctctctctctctccctctgtctttctctctctctctctctctctgtcctttcctcctggacagatccacagttatacacagaaacaaacacacacgcacgtagagaagtgattcacaaacacttaaagacataaatcacaggtgcaaagccatacctgggctcaaaaacctccaagagaacgcagcctcagacccacccaggggccaggggccaggctgtttgcgagaccagcccaggcgggacccaggcttgcacgggcaggtacacgacattcttgggcatacgcagcccgcctggccggagctgtgggagtcctcagccccaagacccagcaggcgtctgaggcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatatttt

SEQ ID NO: 2340 - DNA, 2353 bp, Homo sapiens
gcctgtcagggtgttgtgggggtgcccagctgcctgtcagaccctgaggactaccagacagagagtgggcagccatttcccgggaggcttccccttcccccacctcactctcttgccatacgggggtcaggagtcacgtgtagccacagcgctctgggccaggggtcggggctctggtgtggctcccccaggccctggctgtatgtgggtgggcatgtggcctccccccaccctgtgtgttaggaactcgtgtcctgtcccggagtgtctgtctctgtttcacttcttgtgttcccgtgtctgtctgtcttgcatccctagcccgcagtctttttctctgtccctttatctttctgtttttgtctgtgtcctaggtcggtttctgccactggctctcctgtccctgtgatctgggtctctgtgtggtctccgctggcagggggaggggagtgtgaggaaacagaactaaaagtgctgggctgtgtgggtcggggctgtgtggacagagggggcgtggcagccccgggtgggtgtgatctgtggcttgaagggaaggatgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtgggctggagagtgcggagcaggctcatga

SEQ ID NO: 2341 - DNA, 5767 bp, Homo sapiens
gattcacaaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttgggtaattttgttcccttagggaactgagctttctcatttgtaaatgcaaacaggctgttgggaggatcaaatgagatccaggggtgaaaacagcttagtttactttcaggaatttacccacgcggtatataaaggcaaaatattattatagtcaggtgattgtagattgaggaacccatttcctcattctgcaaattgcaaacctgagggcccaaagagggacaggggcttgccccaggtctcagcaggctgtgagcaagagctaaagcctaatcctcctgcctttgggcctggagcccttccttgtaccccaggggtcagtgtctttgttggatacaggcttagattgactgactgtaccctgagaacctaggggagtccctgttcccaattcttctcctacccccaccttggcctgatggaggaagaccctgctgtgttgagatgagcaccagagccaagaagctgaggaggatctggagaattctggaggaagaggagagtgttgctggagctgtacagaccctgcttctcagctcccgcctcaggccgagatgaggagcccttcagaatagctgctgtctctgggaggacccgggcgtccttggcagcccagctgctctggacaaagccctgccagtcaggcctccgctggcaggaaccatggcagaggctggggatgctgcgctatcggtggccgagtggctgcgggcattgcacctggagcagtacacggggctctttgagcagcatggcctggtgtgggccactgagtgccaaggcctcagcgacacccgcctgatggacatgggcatgctactccctggtcaccgccgccgcatcctggctggcctgctccgtgcccatacctcaccggcccctgcaccccgccccaccccacggcctgtgcccatgaagcgccacatcttccgctcaccacctgtgcctgccactccacccgagccgctgcccaccactacagaggatgaggggctccccgctgccccacccatcccgccccggaggagctgccttccgcccacctgcttcaccaccccatccacagctgccccagaccctgtgctgcccccgctgcctgctaagcggcatttggcagagctgagcgttccacccgtgccgccccgcaccggacccccccgcctgctggtgagcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 2342 - DNA, 4778 bp, Homo sapiens
gcctgtcagggtgttgtgggggtgcccagctgcctgtcagaccctgaggactaccagacagagagtgggcagccatttcccgggaggcttccccttcccccacctcactctcttgccatacgggggtcaggagtcacgtgtagccacagcgctctgggccaggggtcggggctctggtgtggctcccccaggccctggctgtatgtgggtgggcatgtggcctccccccaccctgtgtgttaggaactcgtgtcctgtcccggagtgtctgtctctgtttcacttcttgtgttcccgtgtctgtctgtcttgcatccctagcccgcagtctttttctctgtccctttatctttctgtttttgtctgtgtcctaggtcggtttctgccactggctctcctgtccctgtgatctgggtctctgtgtggtctccgctggcagggggaggggagtgtgaggaaacagaactaaaagtgctgggctgtgtgggtcggggctgtgtggacagagggggcgtggcagccccgggtgggtgtgatctgtggcttgaagggaaggatgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatatttt

SEQ ID NO: 2343 - DNA, 5145 bp, Homo sapiens
aatttggcggtggcggtgtaagtcggtggcggcgccggtacgcctggtccccgcgtggagtctttactcaaaacagctcccgcctcaggccgagatgaggagcccttcagaatagctgctgtctctgggaggacccgggcgtccttggcagcccagctgctctggacaaagccctgccagtcaggcctccgctggcaggaaccatggcagaggctggggatgctgcgctatcggtggccgagtggctgcgggcattgcacctggagcagtacacggggctctttgagcagcatggcctggtgtgggccactgagtgccaaggcctcagcgacacccgcctgatggacatgggcatgctactccctggtcaccgccgccgcatcctggctggcctgctccgtgcccatacctcaccggcccctgcaccccgccccaccccacggcctgtgcccatgaagcgccacatcttccgctcaccacctgtgcctgccactccacccgagccgctgcccaccactacagaggatgaggggctccccgctgccccacccatcccgccccggaggagctgccttccgcccacctgcttcaccaccccatccacagctgccccagaccctgtgctgcccccgctgcctgctaagcggcatttggcagagctgagcgttccacccgtgccgccccgcaccggacccccccgcctgctggtgagcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatatttt

SEQ ID NO: 2344 - DNA, 3883 bp, Homo sapiens
acctccaagagaacgcagcctcagacccacccaggggccaggggccaggctgtttgcgagaccagcccaggcgggacccaggcttgcacgggcaggtacacgacattcttgggcatacgcagcccgcctggccggagctgtgggagtcctcagccccaagacccagcaggcgtctgaggcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggc

SEQ ID NO: 2345 - DNA, 4914 bp, Homo sapiens
atggcagaggctggggatgctgcgctatcggtggccgagtggctgcgggcattgcacctggagcagtacacggggctctttgagcagcatggcctggtgtgggccactgagtgccaaggcctcagcgacacccgcctgatggacatgggcatgctactccctggtcaccgccgccgcatcctggctggcctgctccgtgcccatacctcaccggcccctgcaccccgccccaccccacggcctgtgcccatgaagcgccacatcttccgctcaccacctgtgcctgccactccacccgagccgctgcccaccactacagaggatgaggggctccccgctgccccacccatcccgccccggaggagctgccttccgcccacctgcttcaccaccccatccacagctgccccagaccctgtgctgcccccgctgcctgctaagcggcatttggcagagctgagcgttccacccgtgccgccccgcaccggacccccccgcctgctggtgagcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttaccct

SEQ ID NO: 2346 - DNA, 7514 bp, Homo sapiens
agcggcggccgaggcgaggcgcgggagcacctgagcaaggcgcgggcgccgggctcggcgtttccggagctgagcgcgggtccgcggcccgcgctccccgcctccaggtgcggcggccgcgacacgccggccccactaacagcgccgcccgcgcggccgccgccaggcagcagaggcgactgcggacagccggcggggaccgggaaagaggaggcctggcgcctccggcagaggggcgaggaccgagcgcccaaggctgggagagacgccggcgctgagcttcccagcgccgcctcacctcgcttttcgaactccgcgacccgagcgcaaggcttaagcaggtaaagcagtcactgtgaagaaaataacattttaagaaacttttctgtcacaattgatagaggaaaagccagtagagaagtacatcttcttgtgtgtgtgtctcatcgtgccactttttgtaactcagcttagtaatgaagccaccattatgtcctcagtcagtgaagtaaatgtggatataaaagatttcctaatgagcattaatttggagcagtatctcttacatttccatgagtctggttttactactgtgaaggactgtgcagcaataaatgacagcctgctgcagaaaattggaatatcacctacaggtcaccgtaggaggatacttaaacagttacagataatcttgtcaaaaatgcaagatattccaatatatgcaaatgttcataaaactaagaagaatgatgacccttcaaaggattaccatgttccatcttctgatcagaatatctgcatagaactttccaattctggtagtgttcagacatctagcccaccgcagttggagactgttagaaaaaatcttgaagacagtgatgcaagtgtggaaagaagccagtatcctcaatcagatgataagctgtctcctcctaaacgcgacttccccactgcagaggaaccacacctgaatttgggttctttgaatgattctttatttggtagtgacaatattaaaatagaatcattgattacaaagaagactgtggatcacacagttgaagaacaacaaacagaaaaagttaaattgatcacagaaaatctcagtaagctccctaatgcagactctgaatgcctttcttttgttggctgttcaacatcaggaacaaattctggaaatggaacaaatggtttattagaaggatcaccaccatccccattctttaagtttcaaggagaaatgattgtaaatgacttgtatgttccatcatcaccaatcctagcacctgtgagaagtcgtagcaagttggtttcaagaccatctcgatcttttctgctaagacatcgacctgtaccagagattccagggtcaacaaaaggagtttctgggagctatttccgtgaaagaagaaatgttgctacctcaactgaaaaatctgtggcatggcaaaattcaaatgaggagaattcatcttccatctttccttatggagagacctttctcttccagagactagaaaattccaagaagcgatctataaagaatgaatttttgacccagggagaagcactcaaaggggaagcagctactgcaacaaactcttttatcatcaaatcaagcatatacgataacagaaaggagaaaataagcgaggacaaggtggaagatatttggatacctcgagaggacaaaaacaattttttgatagacactgcttctgaatcagaatactcaacagtagaagaatgctttcagagtttaagaagaaaaaattcaaaggcatctaaatctaggactcaaaaagccttgattttggactccgttaataggcacagttatccgttaagctcaacaagtggaaatgctgattcatcagccgtttcttcacaggcaatatctccctatgcctgcttttatggagcatctgcaaagaaggttaaatcaggatggctggataaactctctcctcaaggaaaacgcatgtttcaaaagagatgggtgaaatttgatggccttagcatttcttactacaataatgagaaggagatgtattcgaaaggaataattcccctttctgctatatcaacagtacgagttcaaggagacaacaaatttgaagttgttacaacacaaagaacttttgtttttagagtagaaaaagaagaggagagaaatgactggatcagcatactattaaatgcactgaaatcacaatcccttacctcgcagtctcaagctgttgttacacctgagaaatgtggatatcttgaattgagaggctataaggcaaaaatttttactgtgttaagtggaaacagtgtgtggctttgcaaaaacgaacaggattttaagagtggacttggtattaccataattcctatgaatgtagcaaatgtaaagcaagtggaccgaactgtgaaacaatcttttgaaataatcactccctacaggagtttcagctttacagccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttgtcatctgtaagaagtgtgcaggacagcatagatctttaggaccaaaagattccaaggttagaagtctaaaaatggatgctagcatttggagcaatgaactcatcgagctttttattgtcattggaaacaaaagagcaaatgacttttgggctggtaatcttcaaaaggatgaagaattacatatggactcaccagtagaaaagagaaaaaactttattactcagaaatataaagaaggaaaattcagaaaaactcttttggcatctctcaccaaagaagaattaaataaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggcccatctttatctttgagatctacttaccctccgaacgtgtgtttttatttggagctgaaacatctcaagctcaaagaaaatggacagaggcaatagccaagcattttgttcccttatttgctgaaaacttaacagaagctgactatgatttgattggtcaactcttctacaaagactgccatgccctggatcagtggagaaaaggctggtttgctatggacaaatccagcttgcatttttgccttcaaatgcaagaagttcagggagatagaatgcacttaagaagactgcaagagctaacaatcagcacaatggttcaaaatggggaaaaactggatgttttactcttggtagaaaaagggagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttagatacgcaagatgacaaggaaagaattaaaaaatatggagcatttatacgttctcttccaggggtcaaccgagcaacactagcagctatcattgaacacctgtatagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggttaaagaagatcaagtcaaacaaatggacatagaaaatagctttattaccaagtggaaagacacccaagtttcccaggctggagatttgttaattgaagtatatgtagaaaggaaggaacccgactgtagtattataattcggatatctcctgtgatggaagcagaagaattaactaatgatatattagcgataaaaaatattattcctacaaaaggtgatatttgggccacatttgaagtcattgaaaatgaagagctagagcgtcctcttcactacaaggaaaatgtactggagcaggtgcttcggtggagttcattagctgaacctggctctgcttacctggtggtgaagagattcttaaccgctgacacaattaaacactgcagtgaccggagtacactgggaagcatcaaagaaggaatcttgaaaatcaaagaagaaccatccaaaatactatctggaaataagtttcaagaccggtattttgttttacgagatgggtttctctttctttacaaggatgtgaagagtagtaaacatgacaagatgttttctctcagttccatgaagttttatcgtggagtgaaaaagaaaatgaagcctccaacaagctggggattgaccgcatattctgagaaacatcactggcacctgtgttgtgatagttcacgaactcagacggagtggatgaccagtatctttattgcccagcatgaatatgatatatggccaccagctggaaaggaacgaaaacgttcaataaccaaaaatcccaaaattggaggtttgcctctgattcctatacagcatgaggggaatgcaaccttggcccggaaaaatattgagagtgcaagagcagaacttgaaaggctgcggctcagtgaaaagtgtgataaagagtccgtggactctagcttaaaggagagagcttccatggtggcccactgcctggagcacaaggacgataaacttcgaaatcgaccccgaaaacatcggagtttcaactgcctggaggacacagagcctgaagccccacttgggcaaccaaaaggccataaaggcctaaagacattgaggaagactgaggacaggaatagcaaagctactttggactctgatcataagttaccatcaagggtaattgaagaacttaatgtggttctacaacggtcaagaacccttccaaaagaattacaggatgagcagattttgaagtaggaaataaaatgaattgctccccagattatttttttaatattgtatgcaatctttatgtgtaactccaaaactgaactataagataattcataagaatttgcctattgataggcaaatttgtctatgcttaggcatttaaggagcatttaaaaatatgtatatatgtgactgaatgtaagattaactttattttggtctgaacaaaccttgtaaagttccattgtattaacgtgtgtaagaagacattgggttacttaggtggtcagtccttttaaagtagttgtctgttaagtggtataatttatgagcagaaatctcaaactgtactgtattgtataaaatgctgtgtttaaatgaagcctaagaaactatctgtaacatattttgcactttgagaaaccttgtatattaaattaccatatgtttttaggtttacagaagttctaccttagggaaaagaaagggaagtaaattgaaaaaggggggagaatttattgtagtggctgcctaaaaaccactggagtttttaaaagaagcaaggagttaaatgtcctgcaaaacaaggaagtgagctaagattcattctagttcactaatgaccagaacttgtcaatgagaaaccacttgttaagaaaaagtccagtgtttatttctcaagagtaatattcggccaacagatgtaaataatagcactagccactcttattaatatttatagtgttagaaaaccagccacattacagattcactacgtttgagctcattgttggtggctgctaagaggaaacttacactgcattggagaggttgtgtacacaggacctggcctggatgctgattgcactgtcattgtatgcaagcattttgtcttttttcagaatttctgactatacttttggtacgaacaaaattcatcaccacagggtcctgttgttttgtttgatttttagatttttttaaattattattaaggttgtaatgtttttctccgagttgtcagaaataactggaagaatacaatatatggccattatggagccaggggctagttggtggtttactatacatttgggggctacctggtcacatttaatctaggtttttttttctttttttaagtaaaggtgtggtctcttccctgtacttatgaataaggacaaagccctatttttgtttccacataaagatcagctactgaattggtgaatttcctgacagacaatgctatctaaccatagttcatgttaggggaagcatttttccatcagtttctttaaaattggattgtctggtgagttttgatattaaacattatgtagctaagttttttttttttagcatttcttttttatttttcaatctatattcacaggcccatacttcagtcagtccaatcatagtacagtgatgtggtggtagatgctatgaatttcttcattgtaaaatacggatcatttgtattttggggtgataaaatagttcaccatgggtatgagatatttattctttaaatcaaagtaaattagaatttttaaaaagcacaaaactgcaggacagtttatgaaataggtggcactattagggaatcttcctttaaagcaagaaatcatgttatttagaaagaaaaactaatcttaaacatactatttctaataaatatttatatttttatgaaataaagaggtatgtggaaattaatatttggtgatgttggacagtggaaaagtatctagagtttttacctgccttatctgaattcttcttgaaacttgagcttaaactctaatagctgtttccctttctattctgaacaactgtctccatttttcaagtgtgagagataagggctaatgatgacatctcatttattttgagtaaacattaaaattgttttacaagtctacttgaa

SEQ ID NO: 2347 - DNA, 631 bp, Homo sapiens
ggatccggatagacagctggacactccctccattcctctcccctacctttaaataagaagaagctgtagtgagtttcaggcaccaagttatttactcggtagagatcatgaatttgcccgggtgtctgtgctgccccgcaccctgcttgttaaccacgttaagacgactggcctgttaattaactttaattacgatcatttggcttccacctgcctgaacccgataccttacacgggaacctgtatgatgtgagtttaccagattgatctttcttgtttacttttggagacagttctcttgggagaagtggtgtccatcctatttaataaagcttaagcaggtaaagcagtcactgtgaagaaaataacattttaagaaacttttctgtcacaattgatagaggaaaagccagtagagaagtacatcttcttgtgtgtgtgtctcatcgtgccactttttgtaactcagcttagtaatgaagccaccattatgtcctcagtcagtgaagtaaatgtggatataaaagatttcctaatgagcattaatttggagcagtatctcttacatttccatgagtctggttttactactgtgaaggactgtgcagcaataaatgacagcctgctgcag

SEQ ID NO: 2348 - DNA, 6051 bp, Homo sapiens
ggtcgttttctgatgtgacggctgagacatgagatcttcagcctccaggctctccagtttttcgtcgagagattcactatggaatcggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagatctcaagaagccatttgacaaagcctggaaagattatgagacaaagtttacaaaaattgagaaagagaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaagcaagacaggattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctgaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctatcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaagctgcatgtctaaaattacatggagttagtgtctattctttttccccttttgcagcaacttacacagcatttttaacaccttttttttctagtttttttgttcggttttgttttccatcaggaatttgagttctctctaacccagcttactgtgggacataggaaaactcagtagaaatacctttggtgatcttgttgagtttaagtctgatcttgatcttaaactcagtaagccactatctgcaattttgtacattatatagtattttgaagatatggaaccttatgaaaaaaaaatagcaaattagttctttttcccccagaggggaaagttatgttctgcaaatagtgtgtgtcttattttactgttgaacagcaattgctatttatttttttattgcctagaacttcaacatgttgtataggaatcctgtagtgccactagttaaatgccgaattctcatctggatgttaccatcaaacatcagtacacttgtcatttcacatgtgtttaatgtgacagtttttcagtactgtatgtgttaatttctactttttttaatatttaaaattgcttttaaataaacatattctcagttgatccc

SEQ ID NO: 2349 - DNA, 6042 bp, Homo sapiens
ggtcgttttctgatgtgacggctgagacatgagatcttcagcctccaggctctccagtttttcgtcgagagattcactatggaatcggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagatctcaagaagccatttgacaaagcctggaaagattatgagacaaagtttacaaaaattgagaaagagaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctgaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctatcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaagctgcatgtctaaaattacatggagttagtgtctattctttttccccttttgcagcaacttacacagcatttttaacaccttttttttctagtttttttgttcggttttgttttccatcaggaatttgagttctctctaacccagcttactgtgggacataggaaaactcagtagaaatacctttggtgatcttgttgagtttaagtctgatcttgatcttaaactcagtaagccactatctgcaattttgtacattatatagtattttgaagatatggaaccttatgaaaaaaaaatagcaaattagttctttttcccccagaggggaaagttatgttctgcaaatagtgtgtgtcttattttactgttgaacagcaattgctatttatttttttattgcctagaacttcaacatgttgtataggaatcctgtagtgccactagttaaatgccgaattctcatctggatgttaccatcaaacatcagtacacttgtcatttcacatgtgtttaatgtgacagtttttcagtactgtatgtgttaatttctactttttttaatatttaaaattgcttttaaataaacatattctcagttgatccc

SEQ ID NO: 2350 - DNA, 5507 bp, Homo sapiens
cccttcctgcgccgcgctcggctcccgcgcctcgcctggcctggccgctgccgcgggcgagcactgtgcgctgggcagccccgggcccgcgcctcccgcccagccggcgcttcccggtcgcagttcgctttcccacccgagagccgcgagcgcccggccgaacccgcgatggaataatgcccagcggcccgccaggtcccggtcgttttctgatgtgacggctgagacatgagatcttcagcctccaggctctccagtttttcgtcgagagattcactatggaatcggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagatctcaagaagccatttgacaaagcctggaaagattatgagacaaagtttacaaaaattgagaaagagaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctgaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctatcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcat

SEQ ID NO: 2351 - DNA, 2045 bp, Homo sapiens
gcgaagaaggtgtgccgggggctggttggaggcgcgggcggcggggccaatgtggcggtgacgtcacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatttacacattctcacaattgtaaagtttcccctctattttggtgaccaatactactgtaaatgtatttggttttttgcagttcacagggtattaatatgctacagtactatgtaaatttaaagaagtcataaacagcatttattaccttggtatatcatactggtcttgttgctgttgttccttcacatttaagtggtttttcatctttcctccctcctcccacagcctggctatacagtgcatccttgaactgtcagcccacagcagcaatatgcttattctatccacatccctaacatcatgcattcacaaggtcaaagttctggtccacaaacccttccctatagaagttcaatggctgcgaaagaatttgtagtaaaccaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagggataacactgtctacctcacagaaatgttaaactgagacaataaaaaccaaagcataaaaatggattctgaaa

SEQ ID NO: 2352 - DNA, 361 bp, Homo sapiens
gaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagagaggaagctggcgcgtatggcagccgaggagcacactctgcaggacactggacaagacagaggaagaacgtgcaaaacgtgagga

SEQ ID NO: 2353 - DNA, 821 bp, Homo sapiens
gactccttagcagcggagcagcccacggcctgcctgtactgcctgttacatgggccctctggtttgatgtcatcagtggaaatagaagcagggaactgacattctgatttggcatttgcttcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagagaggaagctggcgcgtatggcagccgaggagcacactctgcaggacactggacaagacagaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttt

SEQ ID NO: 2354 - DNA, 3390 bp, Homo sapiens
attgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattccctttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcatatgttgaagcaattttttttaatgttatgttaagtcttaaagagggtggttcactttttgatggtcaaccatttagaagtcttagaactatatttcctcttgtttatacttttaacatagggtttatatgtacattaaatatacttgtgaattagtatttaatggctatttttacaaatatcaactttatgctgatagagcaaatggcatcagtgttacctttaagaaagactaacaacatccagaagatttaaattctcaaacctgtgcctctgttttaggatataagtattatcacaaagtatacttaataaaggctagaaaaatgcttttaaattatggaatctgagatcgttttcagagtgggccatcagaaagaacttagctttatactgtcaaaaaaaggctaagatggtcgagtcattttcattgtgtagtgtacttgcacgtttatttttaggacaaacacatttgaactttatgaattttttttttttttttgcatgtgaaatcttatgaatggctttcattttatacactagaatctgcctcatttactcttaacatatgtttaagtatactggtattaaaacattcaagaaaaggatattgatctaaaatgctacctgagatgcataaacatgtcatcaagtagagaaaatatttttatttttgcccaatattttttagacagtttgattattcttaaaaattgaaaacataagctaaagagatgactaaatggtagattattttgtgtgtgcatgctaggaaaaatgctgttgctttagttttgagctcttcaatgagtctaattgtggtaaggaacaatataaaatcagtttaaagatctttaaaggtagaattttaaataggcatgaaatatagtgagaacttttagtaaacatactacttactctaaaatcaaacattttattttcctaaagaatataggttgccaaaaaatattttatctctaaatataggttagctgtaattatttcatgaatttttttttttttcaatgtaactttttttggtgaagattcatggttcctaagttctgtattcaagtttttggaaatgtttatttaaaaactgttctatacaagtgttcaaaacattgtatctaaagagagtagcctggacttaaaatatttgaaatcagcttatgcgtgccttttaattttttttttaagtttcttactgccacatatggtgtgaagtgacagtaagttgcttaatgacatcctgcagtatctgcttgcttttggagactccagtgagatgttgaaattgttcctgtgcttggtaactactttcctctgccaggctatgggaaagaggatgtaattgtgaataatatacaccatccagtctttaatgtgctgcaacaatgtagtaatttgtttttttcatttgttcccactgcctttgtgtacatagaaaacttaaaaatttcccccagtctattagaagttaagatgttccctaatttattaaatatgcctttattcacaatttgtttttttaggttattcttaatgcattatagaattaagtatgactttgtttatttttattacagtatgtagttattgacatattgtggtttgcagaattatcaattgtataaactaaacctttaaatta

SEQ ID NO: 2355 - DNA, 1261 bp, Homo sapiens
ggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttag

SEQ ID NO: 2356 - DNA, 619 bp, Homo sapiens
acagagccaccaagcagtgctgcatacggggtccacctgtgtgcaccaggatgcctgacaccatgctgcccgcctgcttcctcggcctactggccttctcctccgcgtgctacttccagaactgcccgaggggcggcaagagggccatgtccgacctggagctgagacagtgcctcccctgcggccccgggggcaaaggccgctgcttcgggcccagcatctgctgcgcggacgagctgggctgcttcgtgggcacggctgaggcgctgcgctgccaggaggagaactacctgccgtcgccctgccagtccggccagaaggcgtgcgggagcgggggccgctgcgccgccttcggcgtttgctgcaacgacgagagctgcgtgaccgagcccgagtgccgcgagggctttcaccgccgcgcccgcgccagcgaccggagcaacgccacgcagctggacgggccggccggggccttgctgctgcggctggtgcagctggccggggcgcccgagcccttcgagcccgcccagcccgacgcctactgagccccgcgctcgccccaccggcgcgctcttcgcgcccgcccctgcagcacggacaataaacctccgccaatgca

SEQ ID NO: 2357 - DNA, 1525 bp, Homo sapiens
agaccctgcgcttcggacgaggagcccaagtcctccgagacggggagggagcggcccgcgagggctggagctccgaagagggccgagtaggagctgcatggacagcatgcgtctctccgccggtcccgacgcggggccctcgggcaactccagcccatggtggcctctggccaccggcgctggcaacacaagccgggaggccgaagccctcggggagggcaacggcccaccgagggacgtgcgcaacgaggagctggccaaactggagatcgccgtgctggcggtgactttcgcggtggccgtgctgggcaacagcagcgtactgctggctctgcaccggacgccgcgcaagacgtcccgcatgcacctcttcatccgacacctcagcctggccgacctggccgtggcattcttccaggtgctgccgcaaatgtgctgggacatcacctaccgcttccgcggccccgactggctgtgccgcgtggtgaagcacctgcaggtgttcggcatgtttgcgtcggcctacatgctggtagtcatgacagccgaccgctacatcgcggtgtgccacccgctcaagactctgcaacagcccgcgcgccgctcgcgcctcatgatcgcggccgcctgggtgctgagcttcgtgctgagcacgccgcagtacttcgtcttctccatgatcgaggtgaacaatgtcaccaaggcccgcgactgctgggccaccttcatccagccctggggttctcgtgcctacgtgacctggatgacgggcggcatctttgtggcgcccgtggtcatcttgggtacctgctacggcttcatctgctacaacatctggtgcaacgtccgcgggaagacggcgtcgcgccagagcaagggtgcagagcaagcgggtgtggccttccaaaaggggttcctgctcgcaccctgtgtcagcagcgtgaagtccatttcccgggccaagatccgcacggtgaagatgacttttgtgatcgtgacggcttacatcgtctgctgggcgcctttcttcatcatccagatgtggtctgtctgggatcccatgtccgtctggaccgaatcggaaaaccctaccatcaccatcactgcattactgggttccttgaatagctgctgtaatccctggatatacatgttttttagtggccatctccttcaagactgtgttcaaagcttcccatgctgccaaaacatgaaggaaaaattcaacaaagaagatactgacagtatgagcagaagacagactttttattctaacaatcgaagcccaacaaacagtacgggtatgtggaaggactcgcctaaatcttccaagtccatcaaattcattcctgtttcaacttgagccttgcattcatgcaacttgattcttgtgattgactttttggctcattagctgaattgagctagaaatcacaagaacaaatacactttattaatataaccataaatcaattcattgtgtatgagactgtgtttctagttgcattttcatattgctaccaaa

SEQ ID NO: 2358 - DNA, 2237 bp, Homo sapiens
ggcttggctggggcttcctgccctgagcgcgacaccgactgccccggaccgcgcctccaagcaggctgaagggcttccgctcttggcttccagaaaagtttggagaaagagaatttgaggcggattggagggtggtagcccctccccagccttctttccctcccagaagcctcactctgcacagcgtcccccattcttcccgtcctgattccccatcttcctgacccctccttctccctctcctgggtcgatcccagtcacattttctccttccgaatctcatcctccctcctcctctctatcccagtcctctgaacgatttccgcctatttgcaagccttctccctgtcattctcaacgcttctcctttctctccacctcccctgccactccattttatccatcaaacctctccacttgcatccacaccctcccttcatccttccctcccagcaaaccttgctcatggattctgggcctctgtgggatgccaaccccacccctcggggcaccctctctgcccccaatgccacaacaccctggctgggccgggatgaggagctggccaaggtggagatcggagtcctggccactgtcctggtgctggcgaccgggggcaacctggctgtgctgctgaccctgggccagctgggccgcaagcgctcccgcatgcacctgttcgtgctgcacttagccctgacagacctggccgtggcgctcttccaggtgctgccacagctgctgtgggacatcacctaccgcttccagggccccgacctcctgtgcagggccgtcaagtacctgcaggtgctcagcatgtttgcctccacctacatgctgctggccatgacgctggaccgctacctggctgtctgtcaccccctgcgcagcctccagcagccaggccagtccacctacctgctcatcgctgctccctggctgctggccgccatcttcagcctccctcaagtcttcattttttccctgcgggaggtgatccagggctcaggggtgctggactgctgggcagacttcggcttcccttgggggccacgggcctacctcacctggaccaccctggctatcttcgttctgccggtgaccatgctcacggcctgctacagcctcatctgccatgagatctgtaaaaacctaaaagtcaagacacaggcctggcgggtgggaggagggggctggaggacttgggacaggccctcaccttccaccttagctgccaccactcgggggctgccatctcgggtcagcagcatcaacaccatctcacgggccaagatccgaacagtgaagatgacctttgtcatcgtgctggcctacatcgcttgctgggctcccttcttcagtgtccagatgtggtccgtgtgggacaagaatgcccctgatgaagattccaccaatgtggctttcaccatctctatgcttttgggcaacctcaacagctgctgcaacccctggatctacatgggcttcaacagccacctgttaccgcggcccctgcgtcaccttgcctgctgtgggggtccccagcccaggatgcgccggcggctctccgacggcagcctctcgagccgccacaccacgctgctgacccgctccagctgcccggccaccctcagcctcagcctcagcctaaccctcagtgggaggcccaggcctgaagagtcaccaagggacttggagctggcagatggggaaggcaccgctgagaccatcatcttttaggaaagactcgctggggtctggtactgcccccaggactagtggaggttctctgcccacctcgggcactggaaatgagagctgggagggtaagggttggagttagaggagccctgtctaaagcggagcgaaaaggccagaatgggtcccctaccctggtgtcacagctgcccctagtgtgagggctgcctcataagctcccaatctcagacactggcagtcagggagaatcaaactgcctgtctccctggtcctgccatattcatagggtgtccatgcacacatggtgtcccagatctaggcaggcctaggatggtgctgtctaggggtccacgggtggcaggaattcagaggctggccttgtgccctggctacctgtctccattctaacctgactggcacatctcagcctaaccaggagaggggagaagtgaaaaaccgtgaggaggactctatttggatcctggatttgttgttgttgttgttgttgttagagagaa

SEQ ID NO: 2359 - DNA, 1622 bp, Homo sapiens
cttgctcctcaggcagaggctgagtccgcacatcacctccaggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttcc

SEQ ID NO: 2360 - DNA, 1763 bp, Homo sapiens
ttcacgccaccgcccagctgcccaggagcccagccaggactggccatactgccaccgacacgtgcacacacgccaacaggcatctgccatgctggcatctctataagggctccagtccagagaccctgggccattgaacttgctcctcaggcagaggctgagtccgcacatcacctccaggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttccaca

SEQ ID NO: 2361 - DNA, 1307 bp, Homo sapiens
caggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggtgggtgtagccgtggctagggctgacggggccacttgggcttggccgcatgcccctgtgccccaccagccatcctgaacccaacctagatcctccacctccacaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcc

SEQ ID NO: 2362 - DNA, 1727 bp, Homo sapiens
gatgcactcgatatctcggctgaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatca

SEQ ID NO: 2363 - DNA, 1443 bp, Homo sapiens
gagcttaaactgaagcaagttcggtggacgccggcggcgccctgatctaaagaaacgactcagggactgcggcgcttgcacgtcaacgggagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaagggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaa

SEQ ID NO: 2364 - DNA, 2411 bp, Homo sapiens
agaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaagggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggacttttaggccttgctttacaaaactggtttttaacagctgacatgaatatttcccgtttctattttcttttttttttttttttttttttttttgagacggagtctcgctctatcccccatgctggagtgcagtggcgcgatctcagctcactgcaagctccgcctcccaggttcacgccattttcttgcctcagcctcccgagtagctgggactacaggcacccgctaacatgcccagctaattttttgtgtttttagtagagatggggtttcaccattttagccaggatggtctattttcttctgttgtccagtcactaatttagtctctgcgaagactgtagctcagaacaaaagataagcaaaaaaagtcttcagggtaggactgccaacatataggacattttaatgccatcttctttatatttctgggacattaaaattcaaatctctgttgaaaatgaaaaatgtaaaacttagttgcaaacagtatagaaaataagtgatgatgaaatatttgttttcatacaaacatgctttcccattctaaatagatgctagttttcttttttccttggctgtaaataaaagtgccccaaatgaa

SEQ ID NO: 2365 - DNA, 769 bp, Homo sapiens
cggctgaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaaggtctggacccagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaa

SEQ ID NO: 2366 - DNA, 788 bp, Homo sapiens
ggctccggactccttgggtcaaggctggtggctgtagggtgggtgggtggccgcaggcctcaagcttggccttctgtcttgaggacatgtcggagagttcgccgactcctcccctcgccccacgttcctggttcttcatagctgcttttgggtttcctggctcatcttgcaatataagcctggcgcttcctcactagctctagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctg

SEQ ID NO: 2367 - DNA, 1410 bp, Homo sapiens
cggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaa

SEQ ID NO: 2368 - DNA, 679 bp, Homo sapiens
tttgtctgtattgtgccggacagggcttgctgtgagaagtgtggctatgcaaatacatactcacaaaagaatatttacatatgatgttatatttaagtgtgtaaacaaatatacctctaagtgtggcttaggggacattttcaagtactctgaatattaatgcagactttctggaagttaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtgg

SEQ ID NO: 2369 - DNA, 992 bp, Homo sapiens
ttcagaaaccatgaggaacagaatggccccagagaatccccagccagaccctttcatcaataggaattattccaacatgaaggtgataccaccacaggatccagctagtcccagtttcactctgttatccaagctggagtgcagtggcacggtctcggcttactgcagcctcaacctcccaggttcaactgatcctcccacctcagcctcccgagtagctgcgactacagcaatacggagaaggcataaagaacgtacttctttcacccaccaacagtatgaggagctagaagctctgtttagccagaccatgttcccagatagaaatcttcaggagaaactagctttgagactcgacctaccggagtcaacagtaaaggtttggttcaggaaccggcgattcaaattgaagaagcagcagcagcagcaatcagcaaagcaacgaaaccagatccttccatccaagaagaatgtgcccacctcccccagaacatcccccagtccttatgctttttctcctgtgatttcagatttctacagctcccttccatctcagcccttagacccttccaattgggcatggaactctaccttcactgagagttctaccagtgacttccaaatgcaagatactcagtgggagaggctggtggcctcggttcctgctttgtactctgatgcctatgacatattccaaatcatagaactgtacaatcttcctgatgagaatgagatatccagctcttctttccactgtctgtatcagtatctctcacccacaaagtaccaggtaggaggacagggttcctctctcagcatctttgctggtccagctgtaggcctatctcctgcacaaacctggcccaatatgacaagccaagcctttgaagcctacagtctaacagatagcctggaattccagaaaacctccaatatggtagacttgggatttctctgaccagagtactaataaatatagatcatttagaaaa

SEQ ID NO: 2370 - DNA, 8026 bp, Homo sapiens
aaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaaggaggtgattgtctaggagtaactgtatgtgcgctcagcaccgggtcacaaccaccgtgggatccacttacagagaagatttgtggagagcttcagcctgtttatggtgttactgagaaaggaattgtggccatttgatataattctggatggaagacctcttatttgtattacattgaattagagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactacaacccttgg

SEQ ID NO: 2371 - DNA, 6733 bp, Homo sapiens
ggcttaggtcatagcacaagctcagtgaaagctctatgaggtctctgagactgcatgtgcctccattttgagttgttagtgtagaaaagggcagagttttagcagaaagtaaaggttcaggaatccagctagactcaccagagcccgtgttagtcatggatgatccattcagcccctgcaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactac

SEQ ID NO: 2372 - DNA, 5790 bp, Homo sapiens
cacagacgctcgcgagcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaa

SEQ ID NO: 2373 - DNA, 4598 bp, Homo sapiens
gagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagat

SEQ ID NO: 2374 - DNA, 2427 bp, Homo sapiens
cctcgggttcgcggcccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcagcacatggacatcactggagaggaaaacccactcaacaagctccgcgtgaagattgaaccaggcgttgacccggacgacacctataatgagaccccctacgagaaaggtttctgctttgtttcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaagtta

SEQ ID NO: 2375 - DNA, 2282 bp, Homo sapiens
aacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcagcacatggacatcactggagaggaaaacccactcaacaagctccgcgtgaagattgaaccaggcgttgacccggacgacacctataatgagaccccctacgagaaaggtttctgctttgtttcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaagtta

SEQ ID NO: 2376 - DNA, 1166 bp, Homo sapiens
gccactgggcggtgcatccttcaccctttccgtccttccgcgtctcctccctggccctggaggcttgtccagattgcgccgcattcccgctcatcgcacactgccgtttctaacattttccgtggctttctagatgacctgttgttcatgcacttcacttagtgccctcttggacttttgggccgaggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcagcacatggacatcactggagaggaaaacccactcaacaagctccgcgtgaagattgaaccaggcgttgacccggacgacacctataatgagaccccctacgagaaaggtttctgctttgtttcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccag

SEQ ID NO: 2377 - DNA, 505 bp, Homo sapiens
ctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgttgacccggacgacacctataatgagaccccctacgagaaaggtttctgctttgtttcatacctggcccacttggtgggtgatcaggatcagtttgacagttttctcaaggcctatgtgcatgaattcaaattccgaagcatcttagccgatgactttctggacttctacttgg

SEQ ID NO: 2378 - DNA, 2918 bp, Homo sapiens
ccagcgcgcagctcttccgcctccgccacctgcagctgggcctggagctgcggcccgaggcgcgcgagttggccggctgcctggtgctcgagctgtgcgcgctgcggcccgcgccccgcgcgctcgtgctcgacgcgcacccggctctgcgcctgcactcagccgccttccgtcgcgcccccgccgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctggggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctga

SEQ ID NO: 2379 - DNA, 2146 bp, Homo sapiens
gaggctgaccgtttccgcttccgtccacttggcgagtgagacgctgatgggaggatggacgtactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcgtatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaacca

SEQ ID NO: 2380 - DNA, 1990 bp, Homo sapiens
atgggaggatggacgtactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcaggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcgtatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaacc

SEQ ID NO: 2381 - DNA, 1949 bp, Homo sapiens
ataaggaggtggggcgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagtttcgctcttgtcacccaggctggagtgcagtggcacaatcttgactcgctgcagtctccacctccaggattcaagcgattcccctgcctcagtctcccaagcagctgggattgtagagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaagtg

SEQ ID NO: 2382 - DNA, 1818 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaagtgaa

SEQ ID NO: 2383 - DNA, 618 bp, Homo sapiens
ctttccagagtgttgaatcttccaccagaaaacttgatcacatcaatatctgcagttccaatttcccaaaaagaagtttcgctcttgtcacccaggctggagtgcagtggcacaatcttgactcgctgcagtctccacctccaggattcaagcgattcccctgcctcagtctcccaagcagctgggattgtagagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttg

SEQ ID NO: 2384 - DNA, 4933 bp, Homo sapiens
gcaacggcgccaagcacttccggagctgtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattataaaaatgtgtctagagtctttcttcatggggtctaggtagtcttctgagcccacaggggtctggccagtgaacaccagaggagtgccttcctatcagtcagccccttcttccagagggctgtggaggccccagtggccaaactcggctctgttttccctttctggctgttgggggagagggcacctgtaagtgatccctgtggaatgaagtagaaaatcctgccagttttccgctctcctctccctcagtacaggctgaatcattccccaccacagatagatcccagggttgtggtagagtactgatataaatgtcccaacccccccattctgagacctccggacccctccaaagcagacatgggaatgtagggctgtggaatatggcagggtgaactccagcttcacgggagccctaagggttatgaagagacaacttggggcagaaacaagtgtggagtctaatctcaagggtgaaggacaggaaatgaggtttggattgattaagggggtccacatttgtggtgtcagaagtggcagtagtgtcagtgataagtagctcaggggtagagtggaggctccatagctgtgggcaacatgcacagggcacctgtggctagaagaggcctcatacattgccagtctgaactccgcagctcttcctctggacctcaggtgtgccaagccccacgcttggcacctgggcatacagtggtatgcaagtgattcacgtgctctagcttccaggagcttccaatccatggggaacatagaaggaattgatcactagtgaatgtttgttttttgttttgagacagtctcgctctatcgcccagactggagtac

SEQ ID NO: 2385 - DNA, 1288 bp, Homo sapiens
gggattacaggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattat

SEQ ID NO: 2386 - DNA, 1649 bp, Homo sapiens
tcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggctggaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaggcaaactataggataacacagagccctttttgaaaataaattggcattggagtgttttaccctct

SEQ ID NO: 2387 - DNA, 2278 bp, Homo sapiens
acttccggagctgtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagattgagtctcgctctgttgcccaggctggagtgcagtggtgcaatctctgctcactgcaacctccgtctcccgagttcaagcagttctcctgcctcagcctcctgagtagctgggattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaa

SEQ ID NO: 2388 - DNA, 4846 bp, Homo sapiens
ctgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgtt

SEQ ID NO: 2389 - DNA, 6047 bp, Homo sapiens
gctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattccattagttacttatgtttatttttatagttaaaaaatgactaaaggtggctaatagccacccgtattatgtgccttattcactgttcccacttaatataaaatgtcaaaaattggttgtttctttgcagggaactgtgaatgagcccattcccccaacatttaacttggttaatgaagctttcagagcattttctgaaagatttccaatttctgcatctcagatattgaatttaaattgtttgtgttgtaacagtgatacaaaaatgttcaatagctctttgaatgccactttttttaaagaaaatactttaaaagtcattcttagctaacctcaaaactcctttacattactttcattttagctcactcttaaagctgatactgttatatagggatgaagggagagttttcttaaagaaggtcccaaagttgaagatcgtttgtcattgatactctggccaagtccaggttttaggacaatttaatttactcttatttggatctgtaattatgggagtttatcacttttcctcttcaaagcacttcaacttactgtctaaaacaagtggagaagaaattgccattttttataaaggaggaagataaggctcactgaggttaaataactccctcaatttttcatttccttctacctgaaacttaacatcatgctacctctttgtatcatattttgttattctggtcacagaatgacctagtattctgtaccagggaaggtagttcttaactatattgtacttttaaaccacattaaagactattataaatgcc

SEQ ID NO: 2390 - DNA, 2876 bp, Homo sapiens
ttgtcctgagcgcggagagggcgagctcgggccgcgggcagggcgggagccggcagccggcaaccaagggaggcagaaaggcacaaagatcgcaataatatccgttataacccgctatctaaccccacccccaacacacacccatccatcccaccctccgggagaggcagccggcgatccgctctctgcgccctgggaaaaagccccagccatgagcaatcagtaccaggaggagggctgctccgagaggcccgagtgcaaaagtaaatctccaactttgctctcctcctactgcatcgacagcatcctgggccggaggagcccgtgcaaaatgcggttgctgggagccgcgcagagcttgcctgctccgctgaccagccgcgccgacccggaaaaggccgtgcaaggctcccctaagagcagcagcgccccgttcgaggccgagctgcacctgccgcccaagctgcggcgcctgtacggcccgggcgggggccgcctccttcagggtgcggcagcggcggcggcggcggcggcggcggcggcggcagcggccgccacggccacggcgggtccacgcggggaggcccctccgccgccaccgccaaccgcgcggcccggggaacggccggacggcgcaggggccgccgcggcagccgcggccgcggccgccgcggcctgggacacgctcaagatcagccaggcgccgcaggtgagcatcagccgcagcaagtcgtaccgcgagaacggggcgcccttcgtgccgccgccgcccgcgctggacgagctgggcggcccggggggcgtcacgcacccggaggagcgcctcggcgtggccggcggcccgggcagcgccccggctgcgggtggtggcaccggcaccgaggacgacgaggaggagctgctggaggacgaagaagatgaggacgaggaagaggaactgctggaggacgacgaggaggagctgctggaggacgacgcccgcgcgctgctcaaggagccccggcgctgtcctgtggccgccactggcgccgtggccgcagcagctgccgctgcagtggccacagagggcggggagctgtcacccaaggaggagctgctgctgcacccggaagacgctgagggcaaggacggcgaggacagcgtgtgcctctctgcgggcagcgactcggaggaggggctgctgaaacgcaaacagaggcgctaccgcaccacgttcaccagctaccagctggaggaactggagcgggccttccagaagacgcactacccggacgtcttcaccagggaggaactggccatgaggctggacttgaccgaggcccgagtccaggtctggttccagaaccgtcgggccaagtggcgcaagcgggagaaggcaggcgcgcagacccacccccctgggctgcccttcccggggccgctctccgccacccacccgctcagcccctacctggacgccagccccttccctccgcaccacccggcgctcgactccgcttggactgccgctgccgccgccgccgccgccgccttcccgagcctacctccgcctccgggctcggccagcctgccgcccagcggggcgccgctgggcctgagcactttcctcggagcggcagtgttccgacacccagctttcatcagcccggcattcggcaggctcttttccacaatggcccccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagcacgggcaaggaggtgtgctaaaggctgccctccacacccgcgccccgcgcgcgccccgaaaggtcacctcactcagcaccactcaagaccaaatggaaacagaggaccagcacactcccgagacggcactgagagagcgcagccgccttcacagcagtctggatgcgggcatggcagccctcggcgctccgggacgtggcacctcctcggctggctgtccacccgcccctgcccctgcccctgctactgccaacctcgctccaactccaacatccactctctcttgttcttactttcctgaaaatatcggggaggttttctcccccagacgcctgatattgaagtaaaaaatttaaaaagcccaacctcttcctcctgacaccccacttagcctttcttttctttctttctttctttcttttttttttttaaatagcattttggcgctcgaagttgatctccccagcgagggccccagcgtgaagccagggcccgggaagcaaatgcgagcctgtaagatagctaacagtgcacttaaaggaaaggggcgtcttgttcttgttctcttctttatcatacaccaaccaaggtttttatatcaaaccaaagggaaataatactctgctagaatatggactgttgaagtcaccaaactgtgattattgattctgtacataccattgttattaaaaaaaaaaaaaaaagaacagagctttgtatatttgaaatgttataacgcaattgcactcagcgtggtatggtaaaagtttgtcctcccgtagattcttactgtgttgtagatacggtagggttcctagacaaatatttatgtactcaagccctttatttaacttattaactgtagaggcttccgaaaccttcaagataaaggcaatggtacagtacttttgtgtaatgtgtaattgttaccacttttccttgctatctagtggagaagtgtcacgctcaaaataaaaaaattatatgtttaacaaaa

SEQ ID NO: 2391 - DNA, 2629 bp, Homo sapiens
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatc

SEQ ID NO: 2392 - DNA, 2443 bp, Homo sapiens
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaagggg

SEQ ID NO: 2393 - DNA, 2445 bp, Homo sapiens
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggag

SEQ ID NO: 2394 - DNA, 2524 bp, Homo sapiens
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatc

SEQ ID NO: 2395 - DNA, 2347 bp, Homo sapiens
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatc

SEQ ID NO: 2396 - DNA, 2266 bp, Homo sapiens
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaagggg

SEQ ID NO: 2397 - DNA, 2141 bp, Homo sapiens
gccgacgcgtgcagacgtccttctaatcctagtcttcgtttggtccggttgcactcttcctatagcccagagggcgagagggcctgtggcctgggggaaggaggacgaggttctgcctggatcccagcagtaggacgctgtgccatttgggaacaaaggaatagtctgcctggaatccctgcagatcttggggccggaggccagtccaacccttggagcaggaagaaacgcaaagttgtcaagaaccaagtcgagctgcctcagagccggcccgcagtagctgcagactccgcccgcgacgtgtgcgcgcttctctgggccagagcgagcctgttttgtgctcgggttaagagatttgtcccagctataccatgggccgcactcgggaagctggctgcgtggccgctggtgtggttatcggggctggtgcctgctactgtgtatacagactggcttggggaagagacgagaacgagaaaatctgggacgaagacgaggagtctacggacacctcagagattggggttgagactgtgaaaggagctaaaactaacgctggggcagggtctggggccaaacttcagggtgattcagaggtcaagcctgaggtgagtttgggactcgaggattgtccgggtgtaaaagagaaggcccattcaggatcccacagcggaggtggcctagaggccaaggccaaggcccttttcaacacgctgaaggaacaggcaagtgcaaaggcaggcaaaggggctagggtgggtaccatctctgggaacaggacccttgcaccgagtttaccctgcccaggaggcaggggtggaggctgccaccccaccaggagtggatctagggccgggggcagggcaagtggaaaatccaagggaaaggcccgaagtaagagcaccagggctccagctacaacatggcctgtccggagaggcaagttcaactttccttataaaattgatgatattctgagtgctcccgacctccaaaaggtcctcaacatcctggagcgaacaaatgatccttttattcaagaagtagccttggtcactctgggtaacaatgcagcatattcatttaaccagaatgccatacgtgaattgggtggtgtcccaattattgcaaaactgataaaaacaaaagaccccataattagggaaaagacttacaatgcccttaataacttgagtgtgaacgcagaaaatcagggcaagattaagacgtacatcagtcaagtgtgtgatgacaccatggtctgtcgcttggactcagctgtgcagatggctgggctaagactgttaaccaacatgactgtgactaatcattaccaacatttgctttcctattcttttccagacttttttgctttgttattcctgggaaatcacttcaccaagatacagattatgaaactaattataaactttactgaaaatccagccatgacaagagagctggtcagttgtaaagtaccatcagaattgatttccctctttaataaagaatgggatagagagattcttcttaatatccttaccctatttgagaatataaatgacaacataaaaaatgaagggctcgcatcatccaggaaagaattcagcagaagttcactttttttcttattcaaagagtctggagtttgtgttaagaaaatcaaagcactagcaaatcacaatgatctggtggtgaaagtaaaagtcctgaaagtattaaccaaactctaatttggagtctgtcccaaacaatattgagatatttgcagttggtacgatgtgatttgtaaattctttgtttttcattgtgcgtatatggtaaagagatcttttcagctgctattttggaataatgactatcatatatcataacagtgactgatgttggttgtaatggttgggtttaggatgaaccattttaaggatgccaaatgaaatattagtatttgtacacagaaagaatttattgatttgatcttattacctagattgagattttttaatctttcctctacctaaactgacaatgaattggttatacatcatgcataagctacacttttatattagtttatatttgttattctaagacttgtgtttcatcaataaagttgtgttttaagcagcagaaaaaaaaaa

SEQ ID NO: 2398 - DNA, 1779 bp, Homo sapiens
cttctaatcctagtcttcgtttggtccggttgcactcttcctatagcccagagggcgagagggcctgtggcctgggggaaggaggacgaggttctgcctggatcccagcaggacgctgtgccatttgggaacaaaggaatagtctgcctggaatccctgcagatcttggggccggaggccagtccaacccttggagcaggaagaaacgcaaagttgtcaagaaccaagtcgagctgcctcagagccggcccgcagtagctgcagactccgcccgcgacgtgtgcgcgcttctctgggccagagcgagcctgttttgtgctcgggttaagagatttgtcccagctataccatgggccgcacacgctgaaggaacaggcaagtgcaaaggcaggcaaaggggctagggtgggtaccatctctgggaacaggacccttgcaccgagtttaccctgcccaggaggcaggggtggaggctgccaccccaccaggagtggatctagggccgggggcagggcaagtggaaaatccaagggaaaggcccgaagtaagagcaccagggctccagctacaacatggcctgtccggagaggcaagttcaactttccttataaaattgatgatattctgagtgctcccgacctccaaaaggtcctcaacatcctggagcgaacaaatgatccttttattcaagaagtagccttggtcactctgggtaacaatgcagcatattcatttaaccagaatgccatacgtgaattgggtggtgtcccaattattgcaaaactgataaaaacaaaagaccccataattagggaaaagacttacaatgcccttaataacttgagtgtgaacgcagaaaatcagggcaagattaagacgtacatcagtcaagtgtgtgatgacaccatggtctgtcgcttggactcagctgtgcagatggctgggctaagactgttaaccaacatgactgtgactaatcattaccaacatttgctttcctattcttttccagacttttttgctttgttattcctgggaaatcacttcaccaagatacagattatgaaactaattataaactttactgaaaatccagccatgacaagagagctggtcagttgtaaagtaccatcagaattgatttccctctttaataaagaatgggatagagagattcttcttaatatccttaccctatttgagaatataaatgacaacataaaaaatgaagggctcgcatcatccaggaaagaattcagcagaagttcactttttttcttattcaaagagtctggagtttgtgttaagaaaatcaaagcactagcaaatcacaatgatctggtggtgaaagtaaaagtcctgaaagtattaaccaaactctaatttggagtctgtcccaaacaatattgagatatttgcagttggtacgatgtgatttgtaaattctttgtttttcattgtgcgtatatggtaaagagatcttttcagctgctattttggaataatgactatcatatatcataacagtgactgatgttggttgtaatggttgggtttaggatgaaccattttaaggatgccaaatgaaatattagtatttgtacacagaaagaatttattgatttgatcttattacctagattgagattttttaatctttcctctacctaaactgacaatgaattggttatacatcatgcataagctacacttttatattagtttatatttgttattctaagacttgtgtttcatcaataaagttgtgttttaagcagc

SEQ ID NO: 2399 - DNA, 2762 bp, Homo sapiens
tgggtaccaactctattgcgcagctcgctgccgtgcgtttaacccaggcgaggaggaggaggagaaaattcccccagattcgggcagacacctccggcccacacagccgttcaccccccgtcttttcagtcctggaaaaggaattcgggctttcattgtctaacgtcgacagtctatatttctgctcttcagtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccagcacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 2400 - DNA, 2663 bp, Homo sapiens
gaatcatttgacattctgatgtgcaaacacgaaaaggcagttactgagacccttgtcctggatgctgatccatccaccaggctttcattgtctaacgtcgacagtctatatttctgctcttcagtctgtccttaggatgaagctctaactgaactgaagtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccagcacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 2401 - DNA, 2674 bp, Homo sapiens
gtgggcaaaggtacttaaagccctgaccgtcgttctccgtcctcctctgggtaccaactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccagcacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactg

SEQ ID NO: 2402 - DNA, 914 bp, Homo sapiens
ctctattgcgcagctcgctgccgtgcgtttaacccaggcgaggaggaggaggagaaaattcccccagattcgggcagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctccca

SEQ ID NO: 2403 - DNA, 580 bp, Homo sapiens
cgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcgggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaat

SEQ ID NO: 2404 - DNA, 854 bp, Homo sapiens
acgaaaaggcagttactgagacccttgtcctggatgctgatccatccaccaggctttcattgtctaacgtcgacagtctatatttctgctcttcagtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaag

SEQ ID NO: 2405 - DNA, 821 bp, Homo sapiens
actctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggaggttgggaaaggactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgc

SEQ ID NO: 2406 - DNA, 758 bp, Homo sapiens
tattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagt

SEQ ID NO: 2407 - DNA, 3344 bp, Homo sapiens
tctgagtaccagctccccactgccctgagggcgggccggcctgcggcggagggaaaaaggaagaggagaaggaaattgtcccgaatccctgcagtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtga

SEQ ID NO: 2408 - DNA, 3318 bp, Homo sapiens
tctctcccactcgccgcccgctttccaagacatatgtcccgcttgcagcccatttcgatgctgcgaaacgtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagt

SEQ ID NO: 2409 - DNA, 4041 bp, Homo sapiens
gagggcgggagggctggcccggggtctcgggttgcgcgctgggcctggagggagggggcggcccccgcaccggtccgagttgcggccgcgtggactgcgacccgcgccgcgccgcaccgcgccgcgccctgggaacgccgctccccgcgcgccaacggacccggggaagcccttctggggtccgaggccgcgctgcggggccgcccacgctgcgctccaggagccagagcctgcagggtgggtgtcgggacatgctgatcttccctcaagacagctggcgggcgctctggtcatggaggactgcaatgtgcactcggccgccagcatcctggcctcggtgaaggagcaggaggcccgcttcgagaggctgacacgggcactggagcaggagcggcgccatgttgccctacagctggagcgtgcccagcagcctggcatggtcagtggtggcatgggcagtgggcagcccctgccaatggcctggcaacagctggtcctccaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaagaggagtggttccaccaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacggtgtggggggtgccccacaaggcccagccctgggcaaggaagctttggaagcagcaaggtgggggtcaggctacaggtgccccacctccccagagccctgcagtcacgtgaggcccctgtgcagtagagagcctttctccagcccatgctggctggggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaaggaa

SEQ ID NO: 2410 - DNA, 3558 bp, Homo sapiens
atgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaagaggagtggttccaccaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacggtgtggggggtgccccacaaggcccagccctgggcaaggaagctttggaagcagcaaggtgggggtcaggctacaggtgccccacctccccagagccctgcagtcacgtgaggcccctgtgcagtagagagcctttctccagcccatgctggctggggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaagg

SEQ ID NO: 2411 - DNA, 2700 bp, Homo sapiens
atgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaagaggagtggttccaccaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctag

SEQ ID NO: 2412 - DNA, 2871 bp, Homo sapiens
atggaggactgcaatgtgcactcggccgccagcatcctggcctcggtgaaggagcaggaggcccgcttcgagaggctgacacgggcactggagcaggagcggcgccatgttgccctacagctggagcgtgcccagcagcctggcatggtcagtggtggcatgggcagtgggcagcccctgccaatggcctggcaacagctggtcctccaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctag

SEQ ID NO: 2413 - DNA, 2682 bp, Homo sapiens
atgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctag

SEQ ID NO: 2414 - DNA, 2238 bp, Homo sapiens
cccgggcacctgctgtcaatcgggccaggtgggagcgatgattggccgccgggcccgccctccagaaagccccgcggggctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtcggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggatgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaagg

SEQ ID NO: 2415 - DNA, 1292 bp, Homo sapiens
gaacttcatctctctccccagaaaaggctcaacatcaactatatagccaacatgtccaaggtgtttaagaagaccagctccaatgggaagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgctgaaaacccagaggagacagtctccaagagagactatgtgcggctggttgtccggaaagtacaatttgcaccaccggaggcaggccctggcccctcagcccagaccatccgccgcttccttctgtcagctcagcccctacaactccaggcctggatggacagggaggttcactaccacggagaacccatctctgtcaatgtttctatcaacaactgcaccaacaaggtcatcaaaaaaatcaagatttcagttgaccagatcacagatgttgtcctgtattcactagacaagtacaccaagactgtgttcattcaggaattcacggagactgtagctgctaattccagcttctcccagagctttgcagtaaccccaatcctggctgccagctgccagaaacggggcctggcactggatggcaaacttaagcatgaagataccaacctggcctctagcacaattattagaccgggaatggacaaagagctgctggggatcctggtgtcctacaaagtcagagtcaacctgatggtgtcctgtggtggcatcctaggagacctgacagccagcgatgttggtgtggagctacccttggtcctgatccatccgaagccatctcatgaggccgctagctctgaggacatagtcatcgaggagtttacgcggaaaggcgaggaggagagccagaaggctgtggaggctgagggagatgaggggagctgagcacctcgctctggtgcccgtctgtgtgggagcccccactgtaacactctaataaatcagtttgttcagatgtg

SEQ ID NO: 2416 - DNA, 1309 bp, Homo sapiens
gagctggagactgatgtgaacttcatctctctccccagaaaaggctcaacatcaactatatagccaacatgtccaaggtgtttaagaagaccagctccaatgggaagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgctgaaaacccagaggagacagtctccaagagagactatgtgcggctggttgtccggaaagtacaatttgcaccaccggaggcaggccctggcccctcagcccagaccatccgccgcttccttctgtcagctcagcccctacaactccaggcctggatggacagggaggttcactaccacggagaacccatctctgtcaatgtttctatcaacaactgcaccaacaaggtcatcaaaaaaatcaagatttcagttgaccagatcacagatgttgtcctgtattcactagacaagtacaccaagactgtgttcattcaggaattcacggagactgtagctgctaattccagcttctcccagagctttgcagtaaccccaatcctggctgccagctgccagaaacggggcctggcactggatggcaaacttaagcatgaagataccaacctggcctctagcacaattattagaccgggaatggacaaagagctgctggggatcctggtgtcctacaaagtcagagtcaacctgatggtgtcctgtggtggcatcctaggagacctgacagccagcgatgttggtgtggagctacccttggtcctgatccatccgaagccatctcatgcttctgcaagctctgaggacatagtcatcgaggagtttacgcggaaaggcgaggaggagagccagaaggctgtggaggctgagggagatgaggggagctgagcacctcgctctggtgcccgtctgtgtgggagcccccactgtaacactctaataaatcagtttgttcagatgtg

SEQ ID NO: 2417 - DNA, 1298 bp, Homo sapiens
aagaggctggggaggcaggcatagcaaccagagctggagactgatgtgaacttcatctctctccccagaaaaggctcaacatcaactatatagccaacatgtccaaggtgtttaagaagaccagctccaatgggaagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgctgaaaacccagaggagacagtctccaagagagactatgtgcggctggttgtccggaaagtacaatttgcaccaccggaggcaggccctggcccctcagcccagaccatccgccgcttccttctgtcagctcagcccctacaactccaggcctggatggacagggaggttcactaccacggagaacccatctctgtcaatgtttctatcaacaactgcaccaacaaggtcatcaaaaaaatcaagatttcagttgaccagatcacagatgttgtcctgtattcactagacaagtacaccaagactgtgttcattcaggaattcacggagactgtagctgctaattccagcttctcccagagctttgcagtaaccccaatcctggctgccagctgccagaaacggggcctggcactggatggcaaacttaagcatgaagataccaacctggcctctagcacaattattagaccgggaatggacaaagagctgctggggatcctggtgtcctacaaagtcagagtcaacctgatggtgtcctgtggtggcatcctaggagacctgacagccagcgatgttggtgtggagctacccttggtcctgatccatccgaagccatctcatgaggccgctaggtaatggaatacaagattgggaagccccattcccctcttcccatttccaccctccatgttatgacgatagaaatgtgaaaatgcttccttggggtgctttcaatacatgtgcagtggaaacata

SEQ ID NO: 2418 - DNA, 1579 bp, Homo sapiens
agcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccagcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagc

SEQ ID NO: 2419 - DNA, 4188 bp, Homo sapiens
acaaagctgctcttaaagtgagctggcagcttttagccgcccgtctttgtaaggagaccactgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatatgtggatattcctggagctatggatttatttcttaatttgccacttgtcatcggtaccattcctctacatccatttggtagcagaacctcaagtgtaagcagtcagtgtagcatgaatatgaactggctcagtttatcacttcctgaaagacctgaagcaccacccagctatgcagaagtggtaacagaggaacaaaggcggaacaatcttgcaccagtgagtgcttgtgatgactttgagagagcccttcaaggaccactgtttgcatatatccaggagtttcgattcttgcctccacctctttattcagagattgatccaaatcctgatcagtcagcagatgatagaccatcctgcccctctcgttgaaggaacacttggttgaatcaagttgatgtgggttccgaactgtatctcttccggctgaggacagagaagtatcttggagacacgtttcagaggaagtggaattacttttgcccagaaaaatggcgaatacatgaaacaaccagtgatcatgctttagaagcctacagcaacattctgagactgctccaacatgcttgaagatctaagcttttctcttttaaaactggcacatactcagagcagtcttcttagcctatggtcgtacgtgtcaagacatcacgttgtaaagagggatgatttccttcttttgatttgaaaatttgcacatgctcaatgcttacattgtgcggttcgacgtcactacagcttctttttttttttttttttttttctatttttgccagactcttgatactcttaaaacttgtttgtggtcagcacaacaaggaacaaaacaaagctttgaaaaaactttaacatgaaaaaacgcactgacatttttttttatttaatatagcctggactttacctgcgtatgcacatgctcagaattgtctactaggctgactatgtatcacctcttcagcttggatccaattgtggatttatttacaaacatcaaatgccttcaagccaatcctttttgctgtatgttttgcagcctactgtagtagatacgcaacagataatgtgggaaaaaaagagataagaggaggaagctaataagagactgtcaagattgtataccttcttggtttcttttaagaatttgttgcctttctactattacagcaaagcagcattttgttactgactgcctaaaatcacttaatctcaggtgaacgcatcacttgccaaactgttggaatgctatttgtgttttgttgcactgtttttttcgtttgtttgtttgtttatttggttggctttttggagagggaaatttggaaacgggacatacacaaaagttacacacccacattccctttttatcatgacatacaagaagaaactagcagagctaagaatggagtgaagaaaggcagtatggcaggcaccagcaaagagttgagggctgttgctcttaaaaattattttttttattattattttgaaagtatggaagttttccattcactggggaaaggagggaaaagtgcatttatttttatacagagttacttaattacctccaaaacacatatgttggaaatcgcttttgctggtgcaaagtatattaatgagcaggaatacatacattgaggttatgaatagagagctcaatttgtacctttgctgtcttgctcaagcttggtatggcatgaaaactcgactttattccaaaagtaacttcaaaatttaaaatactagaacgtttgctgcgataaatcttttggatttttgtgtttttctaatgagaatactgtttttcattacctaaagaacaatttgctaaacatgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggcttttccataagtggcctttaagaaaacatggaagacaattcatgtttgacaaatgctgacagggtgaagaaagcccagtgtaaaaatgaatcgcgttttaagtgattcggttaaagagtttgggctcccgtagcaaactaatactagataataaggaaatgggggtgaaatatttttttattgttgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgtataaaactttatcaaataaagttttattttcccctttaaaatgtatttctttagaggcattacttttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatattctatggctgtttgtaatttctctttttttccttttttatttggtgctgaatatgtccttgtaggctctgttttaagaaaacaatatgtgggaaatgatttaatttttcctattgctcttccttgtggaaaataaagtgttttgtttttttctgttttgtataa

SEQ ID NO: 2420 - DNA, 1895 bp, Homo sapiens
gggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgat

SEQ ID NO: 2421 - DNA, 2204 bp, Homo sapiens
accccgcgcggttccacgcccctggccgcggcccgggcgctgcgctgctcgacgcggcgggcggcgggcggggaccgggggcgggggcggcggcggcggccgggagagcggaggaggcggagcagggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggccttctcaggggtctctgtttcagcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagc

SEQ ID NO: 2422 - DNA, 3336 bp, Homo sapiens
gggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcctgttgggagatcttgcatccagcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgac

SEQ ID NO: 2423 - DNA, 1918 bp, Homo sapiens
ccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatg

SEQ ID NO: 2424 - DNA, 1873 bp, Homo sapiens
ccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatg

SEQ ID NO: 2425 - DNA, 1960 bp, Homo sapiens
aatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagcacccacccccacaccccctcttcccgtccccccagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 2426 - DNA, 1721 bp, Homo sapiens
tggcagcgggcgaggaggctgcgagcgagccgcgaaccgagcgggcggcgggcgcgcgcaccatgggggagaaacccgggaccagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatg

SEQ ID NO: 2427 - DNA, 1368 bp, Homo sapiens
gtttggctggttgctaaggtgaggttggcgctaccggaacataagagtgattggtgttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgcccgtcatccgctcagtcagcgaacagttcaaggaccctgagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccagatggaggacctgtatgaagacttccacatcgtgaagctgccgctgttaccccatgaggtgcggggggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 2428 - DNA, 1280 bp, Homo sapiens
gagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgcccgtcatccgctcagtcagcgaacagttcaaggaccctgagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccagatggaggacctgtatgaagacttccacatcgtgaagctgccgctgttaccccatgaggtgcggggggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 2429 - DNA, 2404 bp, Homo sapiens
gagacagtgagtgcgcgccctgagtcgcaggccgaggagacagtgagtgcgcgccctgagtcgcaggccgaggagacatggctgcacttcgtgacgctgagatacagaaggacgtgcagacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatggggccgggcacagtggctcatgcctataatcccagcactttgggaggccgaggcaggcagatcacctgaggtcaggagtttgataccagcctggccaacatggtgaaatcctgtctctaccaaaaatacaaaaaaaattagctgggcatggtggtgcacacctatagtctcagctactcgggaggctgaggcaggagaattgcttgaacccaggaagtagaggctgcagtgagtaagcatcacgccactgtactccagcctgggcaacagagcaagactctgtctcaaaagcaaaaaaaaaaaaaaaaaaagaaagaaagaaaaagaaaacaacaaatggcagagagccaccatattccaaatcactgaaaaaaataaatgaattatttttatttatttatttatttttttgagatggagtctcggtctgttgcccaggctgaagtgcagtggccccatctcaactcactgcaagctccacctcctgggttcacgccattctcctgcctcagactcccaagtagctgggactacaggcacctaccaccatgcccagctaattttttgtatttttagtagagacggggtttcaccatgttagccaggatggtcttgatctcctgacctcgtgatccgcccgcctcggcctcccaaagtgctgggattacaagcatgagccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaa

SEQ ID NO: 2430 - DNA, 1335 bp, Homo sapiens
gcgtctgacgtcttaccctccacagaatcggaagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaaccaa

SEQ ID NO: 2431 - DNA, 991 bp, Homo sapiens
gcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagaggtcctgcagtgcccttgtctccacctaaccagatacggtcagctttgcctctccatggaataagtgaagactttccaaaaactccagtttgcagtgcttactttttccgttgacctccgagtgctcagcttaacacctacagcagtcacgtgcccaagaacttctgacattgccccagggt

SEQ ID NO: 2432 - DNA, 6276 bp, Homo sapiens
attcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacaggcatgtgccaccatgcccagctaatttttgtatttttagtagaaacgggtttcaccatgttggccagactggtctcaaactcctgacctcaggtgagcctcccaccttggcctcccaaagtgctgggattacaggcgtgagccactgcattcagctcttcttttctttagatatgagagctgaagagcttagacacattttgcatgtattatttgaaaatctgatggaatcccaaactgagatgtattaaaatacaatttttggccgggtgcagtggctcacgcctgtaatcccagcacttggggagggcgaggagggtggatcacgaggtcaagagatggagaccatcctgaccaacatggtgaaaccctgtctctactaaaaatacagaaattagctgggcatggtggcgtgagcctgtagtcctagctactcaggaggctgaggcaggagaatagcctgaacctgggaatcggaggttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataa

SEQ ID NO: 2433 - DNA, 4820 bp, Homo sapiens
ccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataata

SEQ ID NO: 2434 - DNA, 1221 bp, Homo sapiens
ccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggaccagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcaggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 2435 - DNA, 2781 bp, Homo sapiens
gctgggtaaatcccagagtctcagccgcctaagtgtcttccccggaggtgagattatctccgcctgtgctggacacctccctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatcgttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatg

SEQ ID NO: 2436 - DNA, 2790 bp, Homo sapiens
gctgggtaaatcccagagtctcagccgcctaagtgtcttccccggaggtgagattatctccgcctgtgctggacacctccctttctcctgcagccatggatgccgctctgctcctgaacgtggaaggggtcaagaaaaccattctgcacgggggcacgggcgagctcccaaacttcatcaccggatcccgacacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatg

SEQ ID NO: 2437 - DNA, 2939 bp, Homo sapiens
gtcttccccggaggtgagattatctccgcctgtgctggacacctccctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgatt

SEQ ID NO: 2438 - DNA, 1237 bp, Homo sapiens
tttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaacgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccag

SEQ ID NO: 2439 - DNA, 1077 bp, Homo sapiens
gtgagattatctccgcctgtgctggacacctccctttctcctgcagccatggatgccgctctgctcctgaacgtggaaggggtcaagaaaaccattctgcacgggggcacgggcgagctcccaaacttcatcaccggatcccgacacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttct

SEQ ID NO: 2440 - DNA, 3698 bp, Homo sapiens
ggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggaactctagccaagaaccacggcctacactctccaacacaatccagaggccacaactaggtcccacagctaatttacccctggagatgggctcaggacagctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttg

SEQ ID NO: 2441 - DNA, 2542 bp, Homo sapiens
catggcggcgactactgccaaccccgaaatgacatcagatgtaccatcactgggtccagccattgcctctggaaactctggacctggaattcaaggtggaggagccattgtccagagggctattaagcggcgaccaggcaggcttaaagtatttattgttggctttcctcaggctggattttgatgatgatggagaagggaacagtaaatttttgaggtgtgatgatgatcagatgtctaacgataaggagcggtttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagcctttgacatataggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgt

SEQ ID NO: 2442 - DNA, 3701 bp, Homo sapiens
ggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggaactctagccaagaaccacggcctacactctccaacacaatccagaggccacaactaggtcccacagctaatttacccctggagatgggctcaggacagctggcacccagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaa

SEQ ID NO: 2443 - DNA, 2427 bp, Homo sapiens
actgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagc

SEQ ID NO: 2444 - DNA, 2892 bp, Homo sapiens
cttggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgcctgatcttggactcaagattctcctgcctcagaccccgagtagctgggactacagaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtt

SEQ ID NO: 2445 - DNA, 1638 bp, Homo sapiens
gagcaactctgttttcaaagcttttgggtggagctgaagcacactgcttattaaagtacactattcaggcatatcatgtaggtttactttctgtgtttctagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctcctgggacttcaccattttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacagctccttgatgacccagatgtcaagatcaaactcaagatccagtctttaatttatcctgcccttcagcctcttgatgtagatttaccgtcatatcaagaaaattcaaattttctatttctatccaaatcactcatggtcagattctggagtgaatattttaccactgatagatcacttgaaaaagccatgctttccagacaacatgtacctgtggaatcaagtcatctcttcaaatttgttaattggagttccctgctccctgagaggtttataaaaggacatgtttataacaatccaaattatggcagttctgagctggctaaaaaatatccagggttcctagatgtgagggcagcccctttgttggctgatgacaacaaattacgtggcttacccctgacctatgtcatcacctgtcaatatgatctcttaagagatgatggactcatgtatgtcacccgacttcgcaacactggggttcaggtgactcataaccatgttgaggatggattccatggagcattttcatttctgggacttaaaattagtcacagacttataaatcagtatattgagtggctaaaggaaaatctatagtaaaacatgtagctataacatattttaaaaataaaatctgaaaacctcagaaaatttgcattagaaattggtctttcttagaatggtctagttaagttccacatgtagcataattcttaaataggcacttttctgttttttttttcttactgtgggatttcatttcaattttctacattgtctatctgctttttctgagattttccttcttacactgttaatcttattttaaaaaatattacattcttgtatactttatttttgtgagttggctactatttacgatgcaagagaataaatgtgagcaaatat

SEQ ID NO: 2446 - DNA, 6558 bp, Homo sapiens
cggccgcggcggcggggagagcggagggagcgccgcccgcccgcgccgtcctttgtgtggcggcggcggcgcctgggcctgaccgggtccccggggctgagcgccgggctccgcgccgcccctcccgcgcccctgccaagcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaacaaa

SEQ ID NO: 2447 - DNA, 2317 bp, Homo sapiens
gcggccgcggcggcggggagagcggagggagcgccgcccgcccgcgccgtcctttgtgtggcggcggcggcgcctgggcctgaccgggtccccggggctgagcgccgggctccgcgccgcccctcccgcgcccctgccaagcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaaggaatgaatggtggtctccccactcccggcagcactttaggcagcccataagctatgcgagaatgtga

SEQ ID NO: 2448 - DNA, 2458 bp, Homo sapiens
tgacattttctcagcagaatacaaatgcagctacatttcctcccagaggtttctgacatttcttctacacggataacagattctcctaagaaggtgttggtcacaaggaagaaagatctttgtttaatccctctgaaaagaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgacca

SEQ ID NO: 2449 - DNA, 6690 bp, Homo sapiens
atctgtgatgacattttctcagcagaatacaaatgcagctacatttcctcccagaggtttctgacatttcttctacacggataacagattctcctaagaaggtgttggtcacaaggaagaaagatctttgtttaatccctctgaaaagtgtaggaggatcaggtgaccaaggttttttagaattttccctttttgggatctgacgccgacacactattttgaggcagtgacatcatctctttcctctggcgtgccctccttgcggctccatcattcaggccttgtcatctctcacctggactgctgtgaccttcattcattcccaggagaagtccagaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctg

SEQ ID NO: 2450 - DNA, 6409 bp, Homo sapiens
gcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctg

SEQ ID NO: 2451 - DNA, 5661 bp, Homo sapiens
ggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctggcccgggggtcacaggcttggcagctgcggctctgctgtcccgagccactcatgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtgtgtctacgctcagatgcgtcggtggctgggctgccctgctcctggtcaggccggagcccgtcctaagacacacgctttgcagagctgtgcatgcgcagtctgctagtgtgtgtgtgcagcatacgcaggagcctatcctgaattttgtaaaatatcccaacagttcttaaatgaaaactggccttaagtctattcaagcatgacagcatttctctttgaggaattaaaatctttaggaaagtgatcatggctggacagcttcatgccccagaggcagcgagcacccgtcccatggctgccaagtccacagtcggggatgaagcagtcgggtgatgctcccaagtccgcagtcggggatgaagcggtcgggtgatgctcccaagtccgcagtcggggatgaagcggtcgggtgacacacctagctcagccctcccaggccacctgcagctcccagcctgtgctgtgcaggcagggtcagcccatcgccacagtgcactgtagaggccagcacacggcaaattagaaatacaacacgcggagaaaggggtccgtgagcccactcatagaggaatctagaacgttccaggcagcagaggctggcagcgtgggtcccacactgccccacaccgtgcggcaggtgctccatggcgccatgacagagtctgaggccagacctggactggaattgacagcataacccctgttccttctggacatctcccgagttctcagtgggtctctgcggacggttcttcctaatctgcctcttggtacatcacgtaatacagagttcacagactccgggtttggaagtacagagaaacacacaacgtagagagaagacacaggaaactgcgctgcctgtgggggtttctctctggctggctgtacagttcactcaaatgagggttcccattgccatcctaggagaataattagggacaagacagacaagtattaatagcattaaaacagttgtaaaggcgatattttctgagagtaggaaatttggatacaaaagcataagtcagaaagtgaaggtcaccaatccaccaacccgagaacctacagctgatggtgcatttcaggcttcttccacggtctggcctggaaccccacccggctggtgcaggcatcagatcagggtgtagaagtcaccccaagcaagaggaagccaggcagtgaggccctggggtgtggctgcagctgggcccacctgtgcgggggtgggaaggccccatcctcagggagagggcatcggcgccctgacgtcagctccactgggagtggcaggagctgtgggagcccatgggtgagggacccaccaccccgctgcactgtgcattgtgcctcccgtgtggacgccctctctgttgttggcccgcgggtgagggacccaccacccctagggacccaccaccccgccgcactgtgcattctgcctcctgtgtggacgccctctctgttgtcagtggctttgaggtgtcagtgcttacttagatgctggtttaatgctggacccatttgttaaacgcaccttcactttgtcaaaacccaggtttggttggcaggactgggtcttctgcccaatgccaggtgcctgcgcctctcagtggcctggttcttggacagtttgcccccatgtggcagggatagggataaggatctcctctcagtactggaagagaacagccaaccatctgagcccagagtcacagatccatcgtggccccctatgacccccaagccctaccgagggggcactcactctctgcttagccagggggcgtctttcaaaaggtgacctccatgctgtgctgtcgtgggtgtgagacgtgctcatggccttccactgccatctctcccttatctgatgcctaaagtcacgatggggacagagctacccaggggccagccatggggtgaccagccacctgagggtcagtcacctgtggagagcaggcacctgtgaagaccaggcacctgaggactggcgcctacttcccactttggccctacactggcacagagcccctctttattcatttctcatgctgagcatggcacacttctggcctctgggcatttatggatttaagaccaggatggtatttcagaagcttcccacttccttcctattctaaccgagtgcccagctcctttgctgatcatggaaagacccttaataattaggcctgcaggccaggcgcagtggctcatgcctataatcccagcactttaggaggtcaaggtaggaggatcgcttaagcccaggagttcaagaccagcctgggcaacacaggaagaatgtgtctctacaaaaaataattaaaaatcagatctgctgtatccctgaaaaagtctcaatcaacatgcatgttccactcttggagttccctgttctgagggccagccacgtcctgtgtcctggagcttagccctcagcagctcccttcagcctgggcgccgcctgggtcccaaacgtggcagctgctcttccagtctcggggccgaggagggcagggagctcagtgactgagagtcttgtgtatcacatgtcttgagtgtcctggagccaacggctgtcactgggaaaaacaccaggccccaaagatcgaatcagagacgtggctgcgtgtttgcgattgtagccaggcccttcagtgtcatcaaaggagcactggggcctccttaagcacagacggcagcccctgcccaggaggcttcttcaccacgtcctgccctgcagcctcccagacctttagatgcgcccctgcccaaggccctcctggtgacaggtgccagattgagtggtgggttgctgccaggcaggccacgctgtgttgacgctgcactcagcacgtgggtgttggctctgccggttttgtggtgtggggaccctacaggaggctgcggccctgagagcctgggatcagcgaggtgtccgacatcccttcctcaacggcaacaaaaactccccaagtcagcactttggttattttatagccacaaccctcttggaaaacagtggggaagactatggaacatagaaagtgtggatgtatcacttctctctaaaatgtcattgttagcactaattacaggttcatgtttttctgtgtatgtagcttttccctatatagctgaaaaagtattaaagtcaaatataaggtgggaatgggatggaagggaggagatcaatacaacttatatttttgcagtttctactggaagaaaaaagttttcaatacctagaccaacttgttgaatttttaaaacttatgcactataaatgcaactttctctactgctttctcagtgcctttaggaagctttcaaatttttttgtactgtggtttgtattaaatttgcaatattgatgtaaaatacatgacatgctagtacatgtttaacaaaaatttaaa

SEQ ID NO: 2452 - DNA, 2173 bp, Homo sapiens
ggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctc

SEQ ID NO: 2453 - DNA, 2050 bp, Homo sapiens
acaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaa

SEQ ID NO: 2454 - DNA, 1895 bp, Homo sapiens
aggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccgacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaa

SEQ ID NO: 2455 - DNA, 1824 bp, Homo sapiens
cggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagac

SEQ ID NO: 2456 - DNA, 1918 bp, Homo sapiens
gccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcaggacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgca

SEQ ID NO: 2457 - DNA, 1650 bp, Homo sapiens
cacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccgggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgc

SEQ ID NO: 2458 - DNA, 2053 bp, Homo sapiens
aagggtcacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtg

SEQ ID NO: 2459 - DNA, 1948 bp, Homo sapiens
aagggtcacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcaggacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtg

SEQ ID NO: 2460 - DNA, 5159 bp, Homo sapiens
ggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggaatgcaatggcacgatctctgctcactgcaacctccgcctcccgggttcaagcgattttcctgcctcagcctcctgagtacccaggattacaggcaccaggcacctgccaccatgcctagctaatttttgtagttttagtagagacagggtttcaccatgttgcccaggctggtctcgcactcctgacctcaagtcatccacctgcctcagcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctaaggtgggaggatcacttgagcctaggagttagacacctacccagcctgagcaacacagtgagacctcatctctacaaaaaacaaataattagctagatgtcgtggcgcacagctgtagtctcagctacttaggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctccctgga

SEQ ID NO: 2461 - DNA, 1853 bp, Homo sapiens
ccttcctcttcttgatcggggattcaggaaggagcccaggagcagaggaagtagagagagagacaacatgttacatctgcaccattcttgtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaa

SEQ ID NO: 2462 - DNA, 644 bp, Homo sapiens
tcttcttgatcggggattcaggaaggagcccaggagcagaggtcaatttctgctgtcaatgtgattgtggacatctttatgtcttacaggaagtagagagagagacaacatgttacatctgcaccattcttgtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgg

SEQ ID NO: 2463 - DNA, 1899 bp, Homo sapiens
agtgcgtgtctgttttggcaggaagaagacgtttcttccaaggagcagcctccccgctacatccagccagtgtcgcccttacacagctgcatgtcaggaagtagagagagagacaacatgttacatctgcaccattcttggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaagctggagccccgattcctaaattttgtcactcaaattgaaacaaaccagctggccatggtggttgtcatcccagcactttaggaggccaccacaggaggatcactcccgtgatcaaaaccaacctgggcaacatgatgaaactctagctctacaaaac

SEQ ID NO: 2464 - DNA, 2158 bp, Homo sapiens
cctttgggagagaaccttcctcttcttgatcggggattcaggaaggagcccaggagcagaggaagtagagagagagacaacatgttacatctgcaccattcttgagacagggtctcaccatgttgctcaagctggtcttaaacacctgggctcaggcaatgctcccaccttggcctcccaacgtgctcagataatgggcatgagccaccacgcctgaccgcttctggatctcttgatggtgctttctcagaatgcactgatagtgatttatcctgcatctggagaatgaagcatgagacccgtgattaatagatgtgctccaggctcccttgatttgatgttgccccaggcagcctcagaaggaattgtatttcattctctgcaaatcagtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaagctgg

SEQ ID NO: 2465 - DNA, 1991 bp, Homo sapiens
gttctgctcctagacattagagagataatacggctgatagacaacaagaaggtattccaagctgcacaatgaggcccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggacgcctcacatcgaccgccttgccagggaaggcgtgcgactgactcagcacatctctgccgcctccctctgcagcccaagccggtccgcgttcttgacgggaagataccccatccgatcaggtatggtttctagtggtaatagacgtgtcatccaaaatcttgcagtccccgcaggcctccctcttaatgagacaacacttgcagccttgctaaagaagcaaggatacagcacggggcttataggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggcacagtaaggaaactttccttctctttttctcctttcttcacgtgcacacacctctccccaccacggacgatttcactggcaccagcaagcatggcttgtatggggataatgtggaagagatggactccatggtgggcaagattcttgatgctatcgatgattttggcctaaggaacaacacccttgtctactttacatcagatcacggagggcatttggaagctaggcgagggcatgcccaacttggtggatggaatggaatatacaaaggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacagggtcattgacggccgagacctcatgcccttgctgcagggcaacgtcaggcactcggagcatgaatttcttttccactactgtggctcctacctgcacgccgtgcggtggatccccaaggacgacagtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattatt

SEQ ID NO: 2466 - DNA, 2164 bp, Homo sapiens
agtggagacaggctctcaccatgttgaccaggctggtctcgaactcccgacctcaagtgatccgccggcctcggcctcccaaagtgctgggattacaggcgtgaaccaccactcctggcccttctgttacttttccactgctgttgagatagaagtcactgttgggatccaacctttttgtttgtataaactgacaacaagaaggtattccaagctgcacaatgaggcccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggacgcctcacatcgaccgccttgccagggaaggcgtgcgactgactcagcacatctctgccgcctccctctgcagcccaagccggtccgcgttcttgacgggaagataccccatccgatcaggtatggtttctagtggtaatagacgtgtcatccaaaatcttgcagtccccgcaggcctccctcttaatgagacaacacttgcagccttgctaaagaagcaaggatacagcacggggcttataggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggcacagtaaggaaactttccttctctttttctcctttcttcacgtgcacacacctctccccaccacggacgatttcactggcaccagcaagcatggcttgtatggggataatgtggaagagatggactccatggtgggcaagattcttgatgctatcgatgattttggcctaaggaacaacacccttgtctactttacatcagatcacggagggcatttggaagctaggcgagggcatgcccaacttggtggatggaatggaatatacaaaggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacagggtcattgacggccgagacctcatgcccttgctgcagggcaacgtcaggcactcggagcatgaatttcttttccactactgtggctcctacctgcacgccgtgcggtggatccccaaggacgacagtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttcc

SEQ ID NO: 2467 - DNA, 1923 bp, Homo sapiens
atgaggccaaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggacgcctcacatcgaccgccttgccagggaaggcgtgcgactgactcagcacatctctgccgcctccctctgcagcccaagccggtccgcgttcttgacgggaagataccccatccgatcaggtatggtttctagtggtaatagacgtgtcatccaaaatcttgcagtccccgcaggcctccctcttaatgagacaacacttgcagccttgctaaagaagcaaggatacagcacggggcttataggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggcacagtaaggaaactttccttctctttttctcctttcttcacgtgcacacacctctccccaccacggacgatttcactggcaccagcaagcatggcttgtatggggataatgtggaagagatggactccatggtgggcaagattcttgatgctatcgatgattttggcctaaggaacaacacccttgtctactttacatcagatcacggagggcatttggaagctaggcgagggcatgcccaacttggtggatggaatggaatatacaaaggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacagggtcattgacggccgagacctcatgcccttgctgcagggcaacgtcaggcactcggagcatgaatttcttttccactactgtggctcctacctgcacgccgtgcggtggatccccaaggacgacagtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattatt

SEQ ID NO: 2468 - DNA, 1875 bp, Homo sapiens
atgacaagaaacgccagacccaacattgtcctgctgatggcagatgaccttggagtgggggatttgtgctgctacggtaataactcagtgagcacacctaatattgaccgcctggcaagtgaaggagtgaggcttacccagcatctcgcagctgcttccatgtgcaccccaagtcgggctgccttcctgaccggccggtaccccatcagatcagggatggtgtctgcctacaacctgaaccgtgccttcacgtggcttggtgggtcaggtggtcttcccaccaatgaaacgacttttgccaagctgctgcagcaccgtggctaccgcacgggactcataggcaaatggcacctgggtttgagctgcgcctctcggaatgatcactgttaccacccgctcaaccatggttttcactacttttacggggtgccttttggacttttaagcgactgccaggcatccaagacaccagaactgcaccgctggctcaggatcaaactgtggatctccacggtagcccttgccctggttccttttctgcttctcattcccaagttcgcccgctggttctcagtgccatggaaggtcatctttgtctttgctctcctcgcctttctgtttttcacttcctggtactctagttatggatttactcgacgttggaattgcatccttatgaggaaccatgaaattatccagcagccaatgaaagaggagaaagtagcttccctcatgctgaaggaggcacttgctttcattgaaaggtacaaaagggaaccttttctcctctttttttccttcctgcacgtacatactccactcatctccaaaaagaagtttgttgggcgcagtaaatatggcaggtatggggacaatgtagaagaaatggattggatggtgggtaaaatcctggatgccctggaccaggagcgcctggccaaccacaccttggtgtacttcacctctgacaacgggggccacctggagcccctggacggggctgttcagctgggtggctggaacgggatctacaaaggtggcaaaggaatgggaggatgggaaggaggtatccgtgtgccagggatattccggtggccgtcagtcttggaggctgggagagtgatcaatgagcccaccagcttaatggacatctatccgacgctgtcttatataggcggagggatcttgtcccaggacagagtgattgacggccagaacctaatgcccctgctggaaggaagggcgtcccactccgaccacgagttcctcttccactactgtggggtctatctgcacacggtcaggtggcatcagaaggactgtgcaactgtgtggaaagctcattatgtgactcctaaattctaccctgaaggaacaggtgcctgctatgggagtggaatatgttcatgttcgggggatgtaacctaccacgacccaccactcctctttgacatctcaagagacccttcagaagcccttccactgaaccctgacaatgagccattatttgactccgtgatcaaaaagatggaggcagccataagagagcatcgtaggacactaacacctgtcccacagcagttctctgtgttcaacacaatttggaaaccatggctgcagccttgctgtgggaccttccccttctgtgggtgtgacaaggaagatgacatccttcccatggctccctgagaccatgcggaccacgtgttacccaccacaaacttactgttacaatggtcataggagcagagctcacctgactgattcattccatttgggataaaaactgatggcccaacccattgttttatcctcagaaatcagttctttcaagagctcggtgaaattaaagtgggcccatataacagtgaacct

SEQ ID NO: 2469 - DNA, 3161 bp, Homo sapiens
ccctccacctggggctcggcccggcccggcagatgttacaactttttcgaattctctcccgccgtgtcccctcgacccgcccaacttgtgcctccctccccttcccctctggggtcctgcccacctccctgcagggagctgggctgttttaaggactccgggtggggcgagaggccgggaaagcagaggagagagaaattaggaggcgggagaaatccagggcaagaaggaagaggggagtcagaggatggtagagagcactttttggaagctgccacgccgcgtctcaggctggccgggctgagctggggaagagggagcaaaggcggcgcagggcctgcgcttaggcagcgggaggcagctcggcgcgggcctgacctccccagagcgccccgctgcggccgagcagatccggcccagccgtccggcagccagtcccggaccagacactggaccgtccccggggggcgctgaactccctcgcagcatccgagccggcgggccggtggtgcgccctgggcgcgcgaggtggtgaggccccaggagcccggcgcgccgggacgcgcgggccggcttggcgatgcacaccctcactggcttctccctggtcagcctgctcagcttcggctacctgtcctgggactgggccaagccgagcttcgtggccgacgggcccggggaggctggcgagcagccctcggccgctccgccccagcctccccacatcatcttcatcctcacggacgaccaaggctaccacgacgtgggctaccatggttcagatatcgagacccctacgctggacaggctggcggccaagggggtcaagttggagaattattacatccagcccatctgcacgccttcgcggagccagctcctcactggcaggtaccagatccacacaggactccagcattccatcatccgcccacagcagcccaactgcctgcccctggaccaggtgacactgccacagaagctgcaggaggcaggttattccacccatatggtgggcaagtggcacctgggcttctaccggaaggagtgtctgcccacccgtcggggcttcgacaccttcctgggctcgctcacgggcaatgtggactattacacctatgacaactgtgatggcccaggcgtgtgcggcttcgacctgcacgagggtgagaatgtggcctgggggctcagcggccagtactccactatgctttatgcccagcgcgccagccatatcctggccagccacagccctcagcgtcccctcttcctctatgtggccttccaggcagtacacacacccctgcagtcccctcgtgagtacctgtaccgctaccgcaccatgggcaatgtggcccggcggaagtacgcggccatggtgacctgcatggatgaggctgtgcgcaacatcacctgggccctcaagcgctacggtttctacaacaacagtgtcatcatcttctccagtgacaatggtggccagactttctcggggggcagcaactggccgctccgaggacgcaagggcacttattgggaaggtggcgtgcggggcctaggctttgtccacagtcccctgctcaagcgaaagcaacggacaagccgggcactgatgcacatcactgactggtacccgaccctggtgggtctggcaggtggtaccacctcagcagccgatgggctagatggctacgacgtgtggccggccatcagcgagggccgggcctcaccacgcacggagatcctgcacaacattgacccactctacaaccatgcccagcatggctccctggagggcggctttggcatctggaacaccgccgtgcaggctgccatccgcgtgggtgagtggaagctgctgacaggagaccccggctatggcgattggatcccaccgcagacactggccaccttcccgggtagctggtggaacctggaacgaatggccagtgtccgccaggccgtgtggctcttcaacatcagtgctgacccttatgaacgggaggacctggctggccagcggcctgatgtggtccgcaccctgctggctcgcctggccgaatataaccgcacagccatcccggtacgctacccagctgagaacccccgggctcatcctgactttaatgggggtgcttgggggccctgggccagtgatgaggaagaggaggaagaggaagggagggctcgaagcttctcccggggtcgtcgcaagaaaaaatgcaagatttgcaagcttcgatcctttttccgtaaactcaacaccaggctaatgtcccaacggatctgatggtggggagggagaaaactgtcctttagaggatcttccccactccggcttggccctgctgtttctcagggagaagcctgtcacatctccatctacagggagttggagggtgtagagtcccttggttgaacagggtagggagcctggataggagtgggtgggaataaaccagactgggatgcctgtgtctcagtcctgcctcctcacggacttgctctgtgacctcaggtgacccacatgagcttttagcctcagtttcctcatctgtaaaatgagctctaatgactttgtgactctttggtgtggccctggagcctggggccacggtggagttcctggccggccttgccacttgacaactcctttaaggcttcccccttaacacgggatccctgtggtggtgtttgggagttgcctggaggcaactccaagcctggcccccagctgaagcatggcaatctggctgctctctacagggacccccaagcgctgtgggtggagggcaggggtcgggggggttgaccttcttgggtcttcacatggcctaggccagtcctccggtcagactggtgtcaggcaccgtggtgcaaaattcctcttctggcccctccagtacccagagaaactggctgggccattaactgctgcagcaccaagggtggtagaaagagctgtgaagagcccccaaaccagtaccaggacacctgggttctcctgtgacctggggcacagttcttgccctctaggccttgatttccccacctgcaagtggggatgccagccctggctctgcctccttcatgaggctctggaagactggccaaggttgtggaggagcttgtgaacttgattaaagtgtcgtaacatggaa

SEQ ID NO: 2470 - DNA, 472 bp, Homo sapiens
atgcagttctggaaaggtgaatcggttccttctgcctgtctgggttttgcaaccccgtggtgggacaattggccaggtgcatattcctcagaaggtaccagatccacacaggactccagcattccatcatccgcccacagcagcccaactgcctgcccctggaccaggtgacactgccacagaagctgcaggaggcaggttattccacccatatggtgggcaagtggcacctgggcttctaccggaaggagtgtctgcccacccgtcggggcttcgacaccttcctgggctcgctcacgggcaatgtggactattacacctatgacaactgtgatggcccaggcgtgtgcggcttcgacctgcacgagggtgagaatgtggcctgggggctcagcggccagtactccactatgctttatgcccagcgcgccagccatatcctggccagccacagccctcagcgtcccctctt

SEQ ID NO: 2471 - DNA, 1429 bp, Homo sapiens
gggagggcctcctcatgcagttctggaaaggtaccagatccacacaggactccagcattccatcatccgcccacagcagcccaactgcctgcccctggaccaggtgacactgccacagaagctgcaggaggcaggttattccacccatatggtgggcaagtggcacctgggcttctaccggaaggagtgtctgcccacccgtcggggcttcgacaccttcctgggctcgctcacgggcaatgtggactattacacctatgacaactgtgatggcccaggcgtgtgcggcttcgacctgcacgagggtgagaatgtggcctgggggctcagcggccagtactccactatgctttatgcccagcgcgccagccatatcctggccagccacagccctcagcgtcccctcttcctctatgtggccttccaggcagtacacacacccctgcagtcccctcgtgagtacctgtaccgctaccgcaccatgggcaatgtggcccggcggaagtacgcggccatggtgacctgcatggatgaggctgtgcgcaacatcacctgggccctcaagcgctacggtttctacaacaacagtgtcatcatcttctccagtgacaatggtggccagactttctcggggggcagcaactggccgctccgaggacgcaagggcacttattgggaaggtggcgtgcggggcctaggctttgtccacagtcccctgctcaagcgaaagcaacggacaagccgggcactgatgcacatcactgactggtacccgaccctggtgggtctggcaggtggtaccacctcagcagccgatgggctagatggctacgacgtgtggccggccatcagcgagggccgggcctcaccacgcacggagatcctgcacaacattgacccactctacaaccatgcccagcatggctccctggagggcggctttggcatctggaacaccgccgtgcaggctgccatccgcgtgggtgagtggaagctgctgacaggagaccccggctatggcgattggatcccaccgcagacactggccaccttcccgggtagctggtggaacctggaacgaatggccagtgtccgccaggccgtgtggctcttcaacatcagtgctgacccttatgaacgggaggacctggctggccagcggcctgatgtggtccgcaccctgctggctcgcctggccgaatataaccgcacagccatcccggtacgctacccagctgagaacccccgggctcatcctgactttaatgggggtgcttgggggccctgggccagtgatgaggaagaggaggaagaggaagggagggctcgaagcttctcccggggtcgtcgcaagaaaaaatgcaagatttgcaagcttcgatcctttttccgtaaactcaacaccaggctaatgtcccaacggatctga

SEQ ID NO: 2472 - DNA, 4657 bp, Homo sapiens
ggcaaaagaactcggagtgccaaagctaaataagttagctgagaaaacgcacgcagtttgcagcgcctgcgccgggtgcgccaactacgcaaagaccaagcgggctccgcgcggaccggccgcggggctagggacccggctttggccttcaggctccctagcagcggggaaaaggaattgctgcccggagtttctgcggaggtggagggagatcaggaaacggcttcttcctcacttcgccgcctggtgagtgtcggggagattggcaaacgcctaggaaaggactggggaaaatagccctgggaaagtggagaaggtgatcaggaggccggtccactacggcagtttatctgtctgatcagagccagacgcgacgcgtccacttcgcagttctttccaggtgtggggaccgcaggacagacggccgatcccgccgccctccgtaccagcactcccaggagagtcagcctcgctccccaacgtcgagggcgctctggccacgaaaagttcctgtccactgtgattctcaattccttgcttggtttttttctccagagaacttttgggtggagatattaacttttttcttttttttttccttggtggaagctgctctagggaggggggaggaggaggagaaagtgaaatgtgctggagaagagcgagccctccttgttcttccggagtcccatccattaagccatcacttctggaagattaaagttgtcggacatggtgacagctgagaggagaggaggatttcttgccaggtggagagtcttcaccgtctgttgggtgcatgtgtgcgcccgcagcggcgcggggcgcgtggttctccgcgtggagtctcacctgggacctgagtgaatggctcccaggggctgtgcggggcatccgcctccgccttctccacaggcctgtgtctgtcctggaaagatgctagcaatgggggcgctggcaggattctggatcctctgcctcctcacttatggttacctgtcctggggccaggccttagaagaggaggaagaaggggccttactagctcaagctggagagaaactagagcccagcacaacttccacctcccagccccatctcattttcatcctagcggatgatcagggatttagagatgtgggttaccacggatctgagattaaaacacctactcttgacaagctcgctgccgaaggagttaaactggagaactactatgtccagcctatttgcacaccatccaggagtcagtttattactggaaagtatcagatacacaccggacttcaacattctatcataagacctacccaacccaactgtttacctctggacaatgccaccctacctcagaaactgaaggaggttggatattcaacgcatatggtcggaaaatggcacttgggtttttacagaaaagaatgcatgcccaccagaagaggatttgataccttttttggttcccttttgggaagtggggattactatacacactacaaatgtgacagtcctgggatgtgtggctatgacttgtatgaaaacgacaatgctgcctgggactatgacaatggcatatactccacacagatgtacactcagagagtacagcaaatcttagcttcccataaccccacaaagcctatatttttatatattgcctatcaagctgttcattcaccactgcaagctcctggcaggtatttcgaacactaccgatccattatcaacataaacaggaggagatatgctgccatgctttcctgcttagatgaagcaatcaacaacgtgacattggctctaaagacttatggtttctataacaacagcattatcatttactcttcagataatggtggccagcctacggcaggagggagtaactggcctctcagaggtagcaaaggaacatattgggaaggagggatccgggctgtaggctttgtgcatagcccacttctgaaaaacaagggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgaccccatatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaagccaagcaaaaatcaggctgagaaaaagcaaaagaaaagcaaaaaaaagaagaagaaacagcagaaagcagtctcaggttcaacttgccattcaggtgttacttgtggataagcacaaatatttcctgtttggttaaactttaatcagttcttatctttcatctgtttcctaggtaaaccagcaaatttggctcgataatatcgctggcctaagcgtcaggcttgttttcatgctgtgccactccagagacttctgccacctggccgccacactgaaaactgtcctgctcagtgccaaggtgctactcttgcaagccacacttagagagagtggagatgtttatttctcttgctcctttagaaaacgtggtgagtcctgagttccactgctgtgcttcagtcaactgaccaaacactgctttgaattataggaggagaacaataacctaccatccgcaagcatgctaatttgatggaagttacagggtataccatccgcaagcatgctaatttgatggaagttacagggtagcatgattaaaactacctttgataaattacagtcaaagattgtgtcacctcaaaggccttgaagaatatattttcttggtgaatttttgtatgtctgtcatatgacacttgggttttttaattaattctattttatatatatatatatgtttcttttcctgtgaaaagctgtttttctcacatgtgaacagcttgcacctcattttaccatgcgtgagggaatggcaaataagaatgtttgagcacactgcccacaatgaatgtaactattttctaaacactttactagaagaacatttcagtataaaaaacctaatttatttttacagaaaaatattttgttgtttttataaaaagttatgcaaatgactttattttatttttatttcctgcataccattagaataattttatttcatttcttcaaattaccaagcactgtaatactataaattaatgtaatactgtgtgaattcagactataaaaaacatcattcagaaaactttataatcgtcattgttcaaccaagattttgaatgtaataagatgaatatattccttacaaattacttggaaattcaatgtttgtgcagagttgagacaactttattgtttctatcataaactatttatgtatcttaattattaaaatgatttactttatggcactagaaaatttactgtggcttttctgatctaacttctagctaaaattgtatcattggtcctaaaaaataaaaatctttactaataggcaattgaaggaatggtttgctaacaaccacagtaatataatatgattttacagatagatgcttccccttggctatgacatggagaaagattttcccataataataactaacatttatattaggttggtgcaaaactagttgcggtttttcccattaaaagtaataaacttactcttatacaaagtggacactgtggggagatacagagaaatggaagatacggatcctgcctggagtaggtaaccttgcttggaaaccccacatgcaaacgtcatgaggagaattaaaggagtattatcagtaatgaagtttatcatgggtcatcaatgagcatagattggtgtggatcctgtagaccctggtgttttctttgaagtgccctctcctaatgcagaggccttgaagcttacagtatacacttgaaaagtcacagatagctagaattatgatctttgaagttataactgtgatctgaaaatgtgtgtggtggtatgacagcataccattaaatacatttacatcacagctcaaaggactgtgatataatccatttatatcacaactcaaaggactgtgatataatccatttatatcacagctcacagtttctgaaaatgtataaaagaatctataatctagtactgaaattactaaattgggtaagatgatttaaatgattttaattttaacattttatttctagaatatatggctccattttattttatagtgtaaagttgtatttcctaaagtttgtgttttgtcgacagtatcttttaaatgagtcttaaaaataaaggcatattgttcatgtt

SEQ ID NO: 2473 - DNA, 2114 bp, Homo sapiens
acttctggaagattaaagttgtcggacatggtgacagctgagaggagaggaggatttcttgccaggtggagagtcttcaccgtctgttgggtgcatgtgtgcgcccgcagcggcgcggggcgcgtggttctccgcgtggagtctcacctgggacctgagtgaatggctcccaggggctgtgcggggcatccgcctccgccttctccacaggcctgtgtctgtcctggaaagatgctagcaatgggggcgctggcaggattctggatcctctgcctcctcacttatggttacctgtcctggggccaggccttagaagaggaggaagaaggggccttactagctcaagctggagagaaactagagcccagcacaacttccacctcccagccccatctcattttcatcctagcggatgatcagggatttagagatgtgggttaccacggatctgagattaaaacacctactcttgacaagctcgctgccgaaggagttaaactggagaactactatgtccagcctatttgcacaccatccaggagtcagtttattactggaaagtatcagatacacaccggacttcaacattctatcataagacctacccaacccaactgtttacctctggacaatgccaccctacctcagaaactgaaggaggttggatattcaacgcatatggtcggaaaatggcacttgggtttttacagaaaagaatgcatgcccaccagaagaggatttgataccttttttggttcccttttgggaagtggggattactatacacactacaaatgtgacagtcctgggatgtgtggctatgacttgtatgaaaacgacaatgctgcctgggactatgacaatggcatatactccacacagatgtacactcagagagtacagcaaatcttagcttcccataaccccacaaagcctatatttttatatattgcctatcaagctgttcattcaccactgcaagctcctggcaggtatttcgaacactaccgatccattatcaacataaacaggaggagatatgctgccatgctttcctgcttagatgaagcaatcaacaacgtgacattggctctaaagacttatggtttctataacaacagcattatcatttactcttcagataatggtggccagcctacggcaggagggagtaactggcctctcagaggtagcaaaggaacatattgggaaggagggatccgggctgtaggctttgtgcatagcccacttctgaaaaacaagggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgaccccatatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaagccaagcaaaaatcaggctgagaaaaagcaaaagaaaagcaaaaaaaagaagaagaaacagcagaaagcagtctcaggtaaaccagcaaatttggctcgataatatcgctggcctaagcgtcaggcttgttttcatgctgtgccactccagagacttctgccacctggccgccacactgaaaactgtcctgctcagtgccaaggtgctactcttgcaagccacacttagagagagtggagatgtttatttctcttgctccttta

SEQ ID NO: 2474 - DNA, 507 bp, Homo sapiens
atggctcctgggcagcaggctatgggatctggaacactgcaatccagtcagccatcagagtgcagcactggattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaagccaagcaaaaatcaggctgagaaaaagcaaaagaaaagcaaaaaaaagaagaagaaacagcagaaagcagtctcaggttcaacttgccattcaggtgttacttgtggataa

SEQ ID NO: 2475 - DNA, 3354 bp, Homo sapiens
aaaagcgggaatttctctgttgcgcatgtgcgcgctctccgcctgataggagttgtagttctgcgggtgaagctcggcgttactatcaagcaaccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccaatttgttgcccatcacgcgcagcaatgtggagtggcctcttcactcacttaacagaatcttggaataattttaagggtctagatccaaattatacaacatggatggatgtcatggagaggcatggctaccgaacacagaaatttgggaaactggactatacttcaggacatcactccattagtaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaagaaattaagaatattagagcattttattatgctatgtgtgctgagacagatgccatgcttggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttgatattgctggaattcctctgcctcagaacctgagtggatactctttgttgccgttatcatcagaaacatttaagaatgaacataaagtcaaaaacctgcatccaccctggattctgagtgaattccatggatgtaatgtgaatgcctccacctacatgcttcgaactaaccactggaaatatatagcctattcggatggtgcatcaatattgcctcaactctttgatctttcctcggatccagatgaattaacaaatgttgctgtaaaatttccagaaattacttattctttggatcagaagcttcattccattataaactaccctaaagtttctgcttctgtccaccagtataataaagagcagtttatcaagtggaaacaaagtataggacagaattattcaaacgttatagcaaatcttaggtggcaccaagactggcagaaggaaccaaggaagtatgaaaatgcaattgatcagtggcttaaaacccatatgaatccaagagcagtttgaacaaaaagtttaaaaatagtgttctagagatacatataaatatattacaagatcataattatgtattttaaatgaaacagttttaataattaccaagttttggccgggcacagtggctcacacctgtaatcccaggactttgggaggctgaggaaagcagatcacaaggtcaagagattgagaccatcctggccaacatggtgaaaccctgtctctactaaaaatacaaaaattagctgggcgcggtggtgcacacctatagtctcagctactcagaggctgaggcaggaggatcgcttgaacccgggaggcagcagttgcagtgagctgagattgcgccactgtactccagcctggcaacagagtgagactgtgtcgcaaaaaaataaaaataaaataataataattaccaatttttcattattttgtaagaatgtagtgtattttaagataaaatgccaatgattataaaatcacatattttcaaaaatggttattatttaggcctttgtacaatttctaacaatttagtggaagtatcaaaagaattgaagcaaatactgtaacagttatgttcctttaaataatagagaatataaaatattgtaataatatgtatcataaaatagttgtatgtgagcatttgatggtgctcgatgagttacttgtatttgatgggattgtttggatgtatttaatgggagtatttggagtatttaacgggatgtaaaccctggatgtacctgattttgttactgttttattttaataggtaatatatatacagggtaaaagcttcaaatggtacaaaagggttaacagtgatcgtgaagtctctgtcctttccctcttccctgccatccagttccccctccaagaagcaagtaccgaaaccacctgcttacgcatttttagagattggccacaaatttataaacaaatgtatatattcctttccccctacacaaacggtaacatactgcacacattgttctgcatgttgcttctttttccttttttttttcacttaacagtagatatctagaggtgaaattactgagtcaagactatatttagcaaaattacactagatactacaaattacctctaaagaaggtatactaactgataatctcaccatcaatgcatgtcttcttatcctttgccaacctaacagataaaaatgttctatttttatttttctttttatgagtaacgtagagcatattttcatgtatttaacagccactggaatctgctttaccatggcctttcctatttctattctttgcctatttttctgttggttgttggtctttgttttgtattacaggtgtgctttagatattagctttttgtaagagatcctgcaaatatcttctttccagtttgtcattgtcatttgtcttttgactttgttctggtattttttgatatgtagaaatttttattttcatgtaagcaaatttatgaatctttgtacaccataagtatatacaattatgatttgtcaattaaaaatattagtacaaaattta

SEQ ID NO: 2476 - DNA, 1115 bp, Homo sapiens
gtgcgcgctctccgcctgataggagttgtagttctgcgggtgaagctcggcgttactatcaagcaaccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccaatttgttgcccatcacgcgcagcaatgtggagtggcctcttcactcacttaacagaatcttggaataattttaagggtctagatccaaattatacaacatggatggatgtcatggagaggcatggctaccgaacacagaaatttgggaaactggactatacttcaggacatcactccattagtaatcgtgtggaagcgtggacaagagatgttgctttcttactcagacaagaaggcaggcccatggttaatcttatccgtaacaggactaaagtcagagtgatggaaagggattggcagaatacagacaaagcagtaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaagaaattaagaatattagagcattttattatgctatgtgtgctgagacagatgccatgcttggtgaaattattttggcccttcatcaattagatcttcttcagaaaactattgtcatatactcctcaga

SEQ ID NO: 2477 - DNA, 3543 bp, Homo sapiens
atgtggggttgctgtgtctgtggagccctctttgaggggcagaggctcaggcttctccgggctcctggtgatgggctgtcttcccctttcactgtggtttcccgcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttctctggttcccagtttctctggtcattttggtgtaaatccattctaattagtatttagggcagagcttctctctcttttctctttttttccttccacaaaccagtgtactcactggtctccatctttaatatgcaaacaaatcacctgggatcttgtgagaatccggattccgtctcagtagggctcgagtagatcctgaaatcctacatttctatcaaacaatgccttgaggagcacagatttagaccaaagttaggtcgttttccagatctcagagcagacgagtccatggataagtctgtggcccaatccccttcctctccttttaagggtgaaatgactgcatttaaaagaagttaaagagttcctcctgtcccctataaccacaaggaaacaaaaaaatatataaaaacctcaaaaatgcattgccatgattttattattagtgtccaaaatgggactcccaagtaataaatgatttattccagccacagccaaaaaagactttgcctggctaaaagagtctctctctaagtatgtaatatacaagaaatacaattcaaagagatgttcctataagtacattttttacacggcatatatttaaaaaggaggccccttttaatataaaattccggttatataccaatatggttaattagcatttacactatagtttgaacgtattttaaatagcatgatgtgtatacaatgtctcccgcgcccattggcaaccagggtcgtgggaagcttggtgaggagttaaccaggtcctgtggtttaagcagtggagcacccgggattcctgcccccctttctgctcacacaattgcactccattcttccgccttccttgttttctccaaaaccacctgataggggggatgtcctgatttctgaggtgtgcttctcatcatgactgcttcgttttgcccttctgatttccacggcacaagattatctaccaaaatcaaaacagaatggccttactcttctcaggaagaggctggtaggcaggtgcattatcaacaggtctgtgcccatgcagagtgagcagggagaggctgggcactgtggaatttttctgtctgaactcgctcatggccacagaatggtcacccagcttatttaggtgtagacaagtatgacacagttctagaaaatactgactataaaaatgtctctgtgtgtgtgtgtatgtatttatatgtatatgtatatatttttaaaaggctcatcttacttgtaaacatggactgctcaatcactattaaaaagtcagtttaggctgggcgcggtggctcacgcctgtaatcccagaactttgggaggctgaggtgggtggatcactaggtcaggagtttgagaccagcctggccaacatggtgaaaccccatcgctactaaaaaatacaaaaattagccgggcatggtggcgctcacctgtaatcccagctactcgggaggctgaggcaggagagaatcgcttgaaccggggaggtggaggctgcagtgagccgagatcgcaccactgcactccagcctgggcgatggagcaagactccatctcaaaaaaaaaaaagtcagtttaggctgggcgcagtggctcacacctgtaatcccagcactttaggaggctgaggggggtgatcacctgaggtcaggagtttgagaccagcctggccaacatggtgaaatcctgtctctactaaaaatacaaaatttagctgggcatggtagcatgcctgaaaccccagctacttgggaggctgaggcactagaatcacttgaacctaggaggtggaggttgcagtgagtggagatcacgccaacacattctagcctgagggacagagtgagactctatcatctc

SEQ ID NO: 2478 - DNA, 2770 bp, Homo sapiens
ggctgcgcccaggccggcgggcccagcagctgcgaaccgccggcgcaccacctgtttccgcgcccggggacttccccggcggggctcagaagtgtgggatcggtcgcttggcttcccctggcgtcagcgacccagggtaacctcctccactgctgcgtgccgtgcaggcctgcctgtgtgagagccacgtgtgccgcgctctgggcacagccttggaaagtcaggaccgcgacggcagcagagcagaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttc

SEQ ID NO: 2479 - DNA, 2362 bp, Homo sapiens
gaaataggaaagctgcaaaacactgtggagtgctcccgtgtaaataaaaagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaagacttggaatggaaaattatctatgtgggctctgcagaaagtgaagaatacgatcaagttttagactctgttttagtgggtcctgttcccgcaggaaggcatatgtttgtatttcaggctgatgcacctaatccaggactcattccagatgcagatgcagtaggcgtaactgttgtgctaattacttgtacctatcgaggacaagaatttattagagttggctattatgtaaataatgaatatactgagacagaattaagggaaaatccaccagtaaaaccagacttttctaagcttcaaaggaatattttggcatctaatcccagggtcacaagattccacattaattgggaagataacacagaaaaactggaagatgcagagagcagtaatccaaatctacagtcacttctttcaacagatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaaattccgtaagtacatagtcaaaacacaatgtgaagaatttgtttaaaaacatcctgtagaaagtttataagaaaaccagtatttgaacaaattgtggaatataaatacaactatttttaagtaatttttttctctaatgtgttattttatttgttctgaaactaatctgattaaagcatatatattattttcttctcctttatatgtaatgaaagcacttataaagaaacaggaatcattagaccaggttgtaaagatgtcttggcctcccagacagtctttggaccactattttactggcctttgaaagaacaaagtttacttcaactaaaatgtttcttcctgtgaagacatatggtatcattttaatttaaggggcagatttccattcttttttggcatgtccttaaaaagaggatttgaaatcaactatatgctaccaagaactttaggatccaattttccaagccaccgtgaagcctcttatggctactattatagttcatgagatgttggacagcatttggtttgtttggtaagagaagaacaaatatggctaattgttaataaggtcccctggctatggtttttgttcttataacagagtttagaatatcagagcatttcttgaatcatacatcattattgtccagtgaattcaagaccaaatacaatatcgggagaaaatacaaactccctgtgtttaagaataggggattacaatggctcaaattggttcatttgatttctaaaaataccatgacctttaaaaattcttttaatagatcatgttattggcagtatttatataaaaaccatggatttagaaaggtatatttagctttattataatagatacgttactattttggaaatatatatattttcacacctgtagtactcttccccatttcctctgacactcatgcagaatgagatcaggcatatttgtggttgacatactctagatagcttttccaacaaatctttgaaaagcaatcttggaaaggaattcattaactaaatggggtaaaaggtttctttttctttgagagttaagtccttcctcaaaaaattttcttatgctccataaaattgaggtagaatattttcattattcttgcagctaagcaagacagccatatgatgcaggttatgcagtgccttcatatctaaaacttttatactgcactttttaaagcttttatgttgaggaaaggaaaagggcatttgtctaaacatggattctgagttgtatatatttcctatcattctaaaaaagtgaatttgtgaagcaaagttttgccagatgttaaactttgaatttaatataccagattattaaaatattgtccattaactagttcatagattttaaaagtaaaatacttctgactgttaaaactatataaagaaaatctcatttgtctaattgcaattaaaagaaaaatgttaaaatattaaaatgaaaataaaagcattactttccaa

SEQ ID NO: 2480 - DNA, 2059 bp, Homo sapiens
cgctgcgcgctgcgggatgcatctcccggaaaagcgaggcgaggggcgggccacgccggtgcgggaaccctcaggattggccagaaggaggccggcgctgtgactccgtccattcccgccgttgacatccaagtcggagacgctggggattggtttccagcggacacgctaagaagcttggagatagtttcgccctcctcacacgctgcggagagggagctccgctgattggtccgaggagtctgggcgcgcgccgatcggcgctccaggactggctgagggggtgcgcgcgccgccagggagcgttggcggtgattggccagagggcggaggccggctatttgaaggcggcgcgcggactaggtgcgcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcagggcccatctagaggactttgggggccatcagctgcaatccaggtctgtcaaactcagcccctaggaaagaacaggccttgggtctcccctagtcctggccagaaggatgatctcgcttttcctctacaggcctataagaagcaggtacttcagttctaaattctgacttgtgttcttttcgtcttcataaattctaactaaggccactgtgccactgtgcacccttgagtaccattgatccaaagctttcccacagacctccctggcccacctagaggctttcttggtcagtgcctgtcaaggctccagtcctgctgagccaaaggctttgtcattcctttctcttcctgtacatctgagcagacccactccagctttctggtgtcacaggcgggaatgttagttagtaggtagacttagatcccatttctgtcctgctcccaggaagattcttaggtcctcttcaatccagcagcccctcccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaacctgtcctctgctaggaccagggtgatttcaagccagggaagcaactgggaccctgaaaactgtccctccccagcccgctccccctctctgtgccctggtccccttgctgccatgtggatgctgttgtgattgctgtttgtatattatcaaaatgtttttatattaaaaatgtttggtctgaaaattaaaagcacttcatttagaatga

SEQ ID NO: 2481 - DNA, 2482 bp, Homo sapiens
cacagcaacgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgaggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttatgtg

SEQ ID NO: 2482 - DNA, 2835 bp, Homo sapiens
gcagaatatccagtcgtagccacgaaaatacgccgcgtcagtccctgactcgaaaggaagtcctccagagagccgcactaaccatctagcttcctccaccttcagcctgccaggcccgcggccaccgccggcgcgggaggccggcccacctctgcccgcgcgcctggccttaaagcggtcgtggaattatgcttcctcaggcaggcggtggacgcaccgcgggctttttctgtttgaagactacagcgtcacacagcaacgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttatgtgaca

SEQ ID NO: 2483 - DNA, 2678 bp, Homo sapiens
atcccgcggctcctggagccctgccgcccgccccctgcgaacccaggccccgccgccaatggctcgccctgcctctgcgccgcttggcccgtcccctctcaagcatatctcggataacgccccttccgcacctttcacgggcggtgggagctgaggctcctgtcgttatctctgatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccagggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 2484 - DNA, 2433 bp, Homo sapiens
ggagctgaggctcctgtcgttatctctgatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccagggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgaggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 2485 - DNA, 2194 bp, Homo sapiens
gatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactaatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattcc

SEQ ID NO: 2486 - DNA, 1504 bp, Homo sapiens
cccaaacggtgcacggaagagtgaggtgactggcatgtgtgggggcaacacgattctcctccctggggagcagagcagaggcaacccatcccccactcccacccccacactcccctaagttccaatccatttccacctctgtttactgtccaaagtcccgggcactggagatgccacgtttggcgtgcttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaactttttttttttaagagtaaaaagaaatatacctaaa

SEQ ID NO: 2487 - DNA, 759 bp, Homo sapiens
atgaccaaggagtatcaagaccttcagcatctggacaatgaggagagtgaccaccatcagctcagaaaagactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaa

SEQ ID NO: 2488 - DNA, 1552 bp, Homo sapiens
acacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaagtaaaatgggaagagaggtggcgggaggctggctgggggtgcaggggtgcggagggaacccagggtgtgttggggggtgctgggtgggaaacatcagaggatggattctggatgtcaggcctgggaggggatggaggaaagaagaaagctcccggtggggcgcggtggtccacgcctgtaatcccagcacgttgggaggctggggtgggtggattgcctgagctcaggagtttgagacaagcctgggcaacacggtgaaaccccgtctctactaaaatacaaaaaagtagccaggcgtggtggcgtgcacctgttgtcccagctactccagaggctgaggcaggagaaccgcttgaacccgggaggcagaggttgcagtaagctgagatcatgccactgcactccggcctggggacagagcaagactccctctcaaaaaaaaaaaaaaaaagaaaagaaaaaaaagaaaaagaaaagaaagaaagaagaaaggtctccatgatggagccgtcaatcagatgggagtaaagagatgggcccctcattcccactctagtcctggtgagcccccacctcagccccagcctcagtcttgactcagtcccaggtccagcgccagccctatcatgaccaaggagtatcaagaccttcagcatctggacaatgaggagagtgaccaccatcagctcagaaaagactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaa

SEQ ID NO: 2489 - DNA, 6132 bp, Homo sapiens
attggtggaggcggcaagtttaaacagagtcaaaacgccatacttgtttggctcctctttttaatttgcgagtttattgggcttgttttctgttttctagggagtaggttagtggaaaagaaaaagggccgaattcactcccacgacctctacagccgcccctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagagttaggagcccactacaagcttgtgaaaacttggctatgaatgaaggcggtcccccaacagaaaacaattctttaatacttgaagaaaataaaatacccatatcacctattagccctgctttcaatgaatgccatggtgcaacttgcttgccactctctgtacgtcgatctactacctactcatctcttcatgcatcagaaaatagggaactattaaatgtacacagtgccaacgtttcaaaagtttcttttaatgagaaagctgtaactgaaacttcctttaattccgtaaatgttaatggccaaagaggagagaatagtaaacttagtcttacccccaactgttcttcaactttgaacattacacaaagccaaatacattttctaagtccagattcttttgtaaataatagtcatggagctaataatgaactagaattagtaacatgtctttcatcagatatgtttatgaaagataattcacagcctgtgcatttggaatcaacaattgcacatgaaatttatcagaaaattttaagtccagattctttcataaaagataattatggactaaatcaggatctagaatcagagtcagttaatcctattttatcccctaatcaatttttaaaagataacatggcatatatgtgtacatctcagcaaacatgtaaagtaccattatcaaatgaaaattctcaagtcccacagtctcctgaagattggagaaaaagtgaagtttcgccacgtattcctgaatgtcagggttcaaaatctcccaaagctatttttgaagaactagtagaaatgaagtcaaattactacagttttataaaacaaaataatcctaaattttctgcagttcaggatatttctagtcatagccacaataaacaacctaagagacgtccaatactttctgccactgttactaaaaggaaggccacctgtaccagagaaaaccaaactgagattaataaaccaaaagcaaaaagatgtctcaacagtgcagtgggtgaacatgaaaaagtaataaataatcaaaaggaaaaagaagattttcattcttatcttccaattatagatccaatattaagtaaatctaagagttataaaaacgaggtaacaccctcttcgacaacagcttcagttgctcggaaaagaaagagcgatggaagcatggaagatgcaaatgtgagagttgcaattacagaacatacagaagtgcgagaaatcaaaagaatccatttttctccctcagagcctaaaacatcagctgttaagaaaacaaaaaatgtgacaacacccatctcaaaacgtattagcaacagagagaaattaaacctgaagaagaaaactgatttatcaatattcagaactccaatttctaaaacaaacaaaaggacaaaacccattatcgctgtggcacagtccagtttgaccttcataaaaccattaaaaacagatattcccagacacccgatgccatttgctgcaaaaaacatgttttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtctcttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctccgtgtacaacttttaaaatctgactttgttttaaaaaaacataaactgttcattacattcttcatttttatcatttatagttttatgcatgtaataaactaatatgtcataagatg

SEQ ID NO: 2490 - DNA, 4259 bp, Homo sapiens
atggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgtacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccaccttagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgtaagtattagtcagttgcctttctttaagattatttttctgtggtcttaagtctatgacttttatagttttcctttagtaattatcactctaaaatagggttttatgtgtgttcaaacctgctttttgcacggataaaa

SEQ ID NO: 2491 - DNA, 3747 bp, Homo sapiens
tttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtctcttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctccgtgtacaacttttaaaatctgactttgttttaaaaaaacataaactgttcattacattcttcatttttatcatttatagttttatgcatgtaataaactaatatgtcataa

SEQ ID NO: 2492 - DNA, 10887 bp, Homo sapiens
attggtggaggcggcaagtttaaacagagtcaaaacgccatacttgtttggctcctctttttaatttgcgagtttattgggcttgttttctgttttctagggagtaggttagtggaaaagaaaaagggccgaattcactcccacgacctctacagccgcccctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagagttaggagcccactacaagcttgtgaaaacttggctatgaatgaaggcggtcccccaacagaaaacaattctttaatacttgaagaaaataaaatacccatatcacctattagccctgctttcaatgaatgccatggtgcaacttgcttgccactctctgtacgtcgatctactacctactcatctcttcatgcatcagaaaatagggaactattaaatgtacacagtgccaacgtttcaaaagtttcttttaatgagaaagctgtaactgaaacttcctttaattccgtaaatgttaatggccaaagaggagagaatagtaaacttagtcttacccccaactgttcttcaactttgaacattacacaaagccaaatacattttctaagtccagattcttttgtaaataatagtcatggagctaataatgaactagaattagtaacatgtctttcatcagatatgtttatgaaagataattcacagcctgtgcatttggaatcaacaattgcacatgaaatttatcagaaaattttaagtccagattctttcataaaagataattatggactaaatcaggatctagaatcagagtcagttaatcctattttatcccctaatcaatttttaaaagataacatggcatatatgtgtacatctcagcaaacatgtaaagtaccattatcaaatgaaaattctcaagtcccacagtctcctgaagattggagaaaaagtgaagtttcgccacgtattcctgaatgtcagggttcaaaatctcccaaagctatttttgaagaactagtagaaatgaagtcaaattactacagttttataaaacaaaataatcctaaattttctgcagttcaggatatttctagtcatagccacaataaacaacctaagagacgtccaatactttctgccactgttactaaaaggaaggccacctgtaccagagaaaaccaaactgagattaataaaccaaaagcaaaaagatgtctcaacagtgcagtgggtgaacatgaaaaagtaataaataatcaaaaggaaaaagaagattttcattcttatcttccaattatagatccaatattaagtaaatctaagagttataaaaacgaggtaacaccctcttcgacaacagcttcagttgctcggaaaagaaagagcgatggaagcatggaagatgcaaatgtgagagttgcaattacagaacatacagaagtgcgagaaatcaaaagaatccatttttctccctcagagcctaaaacatcagctgttaagaaaacaaaaaatgtgacaacacccatctcaaaacgtattagcaacagagagaaattaaacctgaagaagaaaactgatttatcaatattcagaactccaatttctaaaacaaacaaaaggacaaaacccattatcgctgtggcacagtccagtttgaccttcataaaaccattaaaaacagatattcccagacacccgatgccatttgctgcaaaaaacatgttttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtctcttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaaatatatttatattagatcttgtgttgttatcattcagaaaagatttcggtgctttcaagcccaaaagttatataaaagaagaaaagagtccatactaaccatccagaagtactacaaagcatatctgaaaggaaagattgagcgcaccaactatttgcagaaacgagctgcagccattcaattacaagctgcttttaggagactgaaagctcataatttatgtagacaaattagagctgcttgtgttattcagtcatactggagaatgagacaagacagagttcgatttttaaaccttaagaagactattatcaaatttcaggcacatgtaagaaaacatcaacaacgacagaaatataagaagatgaagaaagcagctgttataattcagactcatttccgagcttatatttttgccatgaaagttctagcatcttaccagaaaacacgctctgctgtcattgtgctgcagtctgcatatagagggatgcaagccaggaaaatgtatattcacatcctcacatctgttataaagattcaatcatattatcgtgcttatgtttctaaaaaggaatttttgagcctaaaaaatgctacaataaaattgcagtcaactgttaagatgaaacaaacacgtaaacaatatttgcatttaagagcagctgcactatttatccagcaatgttaccgttccaaaaaaatagctgcacaaaagagagaagagtatatgcagatgcgggaatcttgtatcaaactgcaagcatttgttagaggataccttgtccgaaagcagatgaggttacaaagaaaagctgttatttcactacagtcttatttcagaatgagaaaggctcggcagtattatctgaaaatgtataaagcaattattgtcattcagaattactatcatgcatacaaagcacaggtcaatcagaggaagaacttcttgcaagtcaaaaaagcagctacttgcttgcaagcagcttacagaggttataaagtacgccagctaatcaaacaacaatctatagctgctcttaaaattcagtctgcttttagaggctataataaaagggtaaaatatcaatctgtgcttcaatctataataaagattcagagatggtacagggcgtacaagactcttcatgatacaagaacacattttttgaagacaaaggcagctgtgatttccctccagtctgcttatcgtggctggaaggttcggaaacagattagaagggaacatcaagctgccttgaagattcagtctgcttttagaatggccaaggcccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagtcagcttatcgtggtatgaaagtgagaaaaagaataaaggattgcaacaaagcagcagtcactatacagtctaaatacagagcttacaaaaccaaaaagaaatatgcaacctatagagcttcagctattataattcagagatggtatcgaggtattaaaattacaaaccatcagcataaggagtatcttaatttgaagaagacagcaattaaaatccaatctgtttatagaggtattagagttagaagacatattcaacacatgcacagggcagccacttttattaaagccatgtttaaaatgcatcagtcaagaataagttaccatacaatgagaaaagcagctattgttattcaagtaagatgtagagcatattatcaaggtaaaatgcagcgtgaaaagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgtacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccaccttagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctccgtgtacaacttttaaaatctgactttgttttaaaaaaacataaactgttcattacattcttcatttttatcatttatagttttatgcatgtaataaactaatatgtcataagatg

SEQ ID NO: 2493 - DNA, 2356 bp, Homo sapiens
agtcctgctccgccccggacaccccgcggccccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaccattgctgt

SEQ ID NO: 2494 - DNA, 1994 bp, Homo sapiens
aaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatct

SEQ ID NO: 2495 - DNA, 2289 bp, Homo sapiens
tttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaa

SEQ ID NO: 2496 - DNA, 584 bp, Homo sapiens
acgcacctgacagctagcggaaggacctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtc

SEQ ID NO: 2497 - DNA, 745 bp, Homo sapiens
ccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagaggtctgtttagggacacaggcgaccaagtacagaaaaagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaag

SEQ ID NO: 2498 - DNA, 828 bp, Homo sapiens
gattgttacgcacctgacagctagcggaaggacctttctgtcctggttccctgaagcatcgagagggaaccgcggccggcaggccggaccgctccggagaggaggcagcggcagtttgagcccctattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccct

SEQ ID NO: 2499 - DNA, 579 bp, Homo sapiens
tactgaacaatgcaactttgagacagaaatatttgagaacatttttgtcagtgaggacattttgatagtgaatattttgtatcttctattaacttgaaatgttttatttgttataaagccaggatatctgatatcaaattaaattgttttttttttccctttagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatgg

SEQ ID NO: 2500 - DNA, 562 bp, Homo sapiens
atgatgaaacttcccgcacgcgttacaggagccaggtcggtataagcgccagcggcctcgccgcccgtcaagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccg

SEQ ID NO: 2501 - DNA, 573 bp, Homo sapiens
aagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaaggtg

SEQ ID NO: 2502 - DNA, 1638 bp, Homo sapiens
gaagcatcgagagggaaccgcggccggcaggccggaccgctccggagaggaggcagcggcagtttgagcccctatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatct

SEQ ID NO: 2503 - DNA, 1812 bp, Homo sapiens
ataagcgccagcggcctcgccgcccgtcaagctgtccacatccctggcctcagcccgccacatcaccctgacctgcttacgcccagattttcttcaatcacatctgaataaatcacttgaagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggact

SEQ ID NO: 2504 - DNA, 1588 bp, Homo sapiens
cctggcctcagcccgccacatcaccctgacctgcttacgcccagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaa

SEQ ID NO: 2505 - DNA, 1939 bp, Homo sapiens
gcggtcacgtgactgctgcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgttcgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaa

SEQ ID NO: 2506 - DNA, 1419 bp, Homo sapiens
cacgtgtcagaagtgtgttaagtgaatccattgcgtggtctcacgtaattctcctaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgttcgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggc

SEQ ID NO: 2507 - DNA, 2393 bp, Homo sapiens
ctaagcagcaagccacgcacctcccgcgctggcgaaatccgagacccgccccttccggaagttttgacactttgtgcgccccgggcaatgcgattgagagggtaatcatccggtccgttatctaaacccgtcactccgggaaacagcgacccgatctttccggatccgcgctctcccagcatcctttgccttccggtatgtggccccgtctggctagtcccgcctagcgcgcccatttcgagcccaagtttccagctcgggtttccaggctcagaattttccaggagtaggttcttgggcagtggctgtgggagctggaatggcgcagctggaaggttactatttctcggccgccttgagctgtacctttttagtatcctgcctcctcttctccgccttcagccgggcgttgcgagagccctacatggacgagatcttccacctgcctcaggcgcagcgctactgtgagggccatttctccctttcccagtgggatcccatgattactacattacctggcttgtacctggtgtcaattggagtgatcaaacctgccatttggatctttggatggtctgaacatgttgtctgctccattgggatgctcagatttgttaatcttctcttcagtgttggcaacttctatttactatatttgcttttctgcaaggtacaacccagaaacaaggctgcctcaagtatccagagagtcttgtcaacattaacactagcagtatttccaacactttatttttttaacttcctttattatacagaagcaggatctatgttttttactctttttgcgtatttgatgtgtctttatggaaatcataaaacttcagccttccttggattttgtggcttcatgtttcggcaaacaaatatcatctgggctgtcttctgtgcaggaaatgtcattgcacaaaagttaacggaggcttggaaaactgagctacaaaagaaggaagacagacttccacctattaaaggaccatttgcagaattcagaaaaattcttcagtttcttttggcttattccatgtcctttaaaaacttgagtatgcttttgcttctgacttggccctacatccttctgggatttctgttttgtgcttttgtagtagttaatggtggaattgttattggcgatcggagtagtcatgaagcctgtcttcattttcctcaactattctactttttttcatttactctctttttttcctttcctcatctcctgtctcctagcaaaattaagacttttctttccttagtttggaaacgtagaattctgttttttgtggttaccttagtctctgtgtttttagtttggaaattcacttatgctcataaatacttgctagcagacaatagacattatactttctatgtgtggaaaagagtttttcaaagatatgaaactgtaaaatatttgttagttccagcctatatatttgctggttggagtatagctgactcattgaaatcaaagtcaattttttggaatttaatgtttttcatatgcttgttcactgttatagttcctcagaaactgctggaatttcgttacttcattttaccttatgtcatttataggcttaacatacctctgcctcccacatccagactcatttgtgaactgagctgctatgcagttgttaatttcataacttttttcatctttctgaacaagacttttcagtggccaaatagtcaggacattcaaaggtttatgtggtaatatcagtgatatttcgaactgtgaaaatggacttaataattagaccatttctacaaagaacaactgaataggtggaaaacatggaatttcttttaggtgcagtggtggtcttcaaattacattagttttttttatatatattttaaacatatgtaagaaattaagtggcaaagaactgagaaagcttaagacctgcttcaaaagcctgaaaaatggaaaaataaaattgttttcagatatctcatatcactctcataatgttggccccttaaaaagcttgggaatgttttgtatgtacaagtttattaaaactgggtatgcttcatattactggaatgaatttattctcttcagagagaaatattaggttagtgcaaaagtaattgtggtttttgccattgaaagtaatggcaaaaccacaattacttttttaccaacctaataacaatgtattagcaaatatttacaaatggtcaggtgatattcttgattgaaaagttgcttaacatttcagtaatataattttaattctaagtcaaaatacaaatgcatagatagtaaatgataaagtagagactcatatatgcctgtctagacatcaaattgttggttattgtttacaatctagaaatgatgaagctctttcactaat

SEQ ID NO: 2508 - DNA, 2558 bp, Homo sapiens
ggaagatggcggccggcgaaaggagctggtgcctgtgcaagttgttgaggtttttttattcattattcttccctgggctcattgtatgtggaactttatgtgtgtgtttggtcattgtcctttggggaatcagactgctgctacagagaaagaaaaaattagtgtcaactagcaaaaatgggaaaaatcaaatggtgattgcattttttcatccatactgcaatgctggtggaggaggagaaagagttttatggtgtgctttaagagccctgcagaaaaagtatcctgaagcagtttatgttgtttataccggcgatgttaatgtcaacggtcaacagatactagaaggtgctttcagaagatttaacatcagattaattcacccagtgcagtttgtttttttaaggaaacgctatcttgtggaagattcactgtatcctcacttcacactgctgggccaaagtctaggatccatttttcttggctgggaagctctaatgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagttgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcactggaagaaatggaaaaaattgaaaa

SEQ ID NO: 2509 - DNA, 1404 bp, Homo sapiens
gagttcgggggtcggcggaagatggcggccggcgaaaggagctggtgcctgtgcaagttgttgaggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcactggaagaaatggaaaaaa

SEQ ID NO: 2510 - DNA, 2360 bp, Homo sapiens
gcgcgcagcccgcggcggccatctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgacggccatgcagttccacctgatgttctactgcacgcggacactgcccaatgtgctggccctgcctgtagtcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggcccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctct

SEQ ID NO: 2511 - DNA, 1488 bp, Homo sapiens
ggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctct

SEQ ID NO: 2512 - DNA, 3924 bp, Homo sapiens
acggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcc

SEQ ID NO: 2513 - DNA, 1398 bp, Homo sapiens
acggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggcttaaa

SEQ ID NO: 2514 - DNA, 4071 bp, Homo sapiens
ggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagtgattgcctcaccatcctatccatgccattctgctattcctcatgctggtgcctctctaccaccaccaccaccaccaccaccaccaccaccaccaccaccacctcctcctcctcctcctcctcctcctcctcctcctcctgctcttgatgtgggagagacttcaaacttacaaccaccaccaccactaccacctccaccttattcctgtgatccaagcggcagtgatttgcctcaagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgc

SEQ ID NO: 2515 - DNA, 1033 bp, Homo sapiens
gacagcggctggtccccggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattagtaa

SEQ ID NO: 2516 - DNA, 1536 bp, Homo sapiens
atgcccctattaaaacttgtacatggctccccattggtttttggagaaaagttcaagctttttaccttggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcat

SEQ ID NO: 2517 - DNA, 1880 bp, Homo sapiens
agcgcggagcttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcataaa

SEQ ID NO: 2518 - DNA, 1528 bp, Homo sapiens
ggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaactctgtgcaacctacatggaggtgggggcagccgatgcctggtccaggctgtgagggacacgtatggagcagataaagaattcactcaa

SEQ ID NO: 2519 - DNA, 1452 bp, Homo sapiens
acacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaactctgtgcaacctacatggaggtgggggcagccgatgcctggtccaggctgtgagggacacgtatggagcagataaagaattcactcaagcagtcctaagaggcactttattgcataggatt

SEQ ID NO: 2520 - DNA, 1895 bp, Homo sapiens
ggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcagaacatatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttctacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacaca

SEQ ID NO: 2521 - DNA, 3371 bp, Homo sapiens
cggaaggccggaggggcagtccgccgcgggggcgagcgcgcatgcgccttcctgggacccacggcaggcgcgaatcccagcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttctacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaagaccaatggaggcttgtctaagtactgcttggccaaaacatgtggttttattattcacagctattcaagtggggaaaaaagagaaacatgtccttaatcccattgtttactcaggaaatgcactttttaaatgtctttaaaaaactgagaaatatttcttgatatttgctttgtctaaacctacttccttcatcagaccatatagtgagcttcatgggagaattgagccccttctttttaatggaaatcactaattttggtattcaaacttacattttagaatgcaagtagtgtgtatttcactgtttagaagtcatatcttagggaattaaatttgtgataatctttttaattactgagaaggcaatttaaactgcttgaagtttgaatatgccttattacacatgcaaatttgattgttttaacaaggcaaataaaccataatcttatttatttccaagaatgcatattttaatacaattaaaaatgaattttcctgaatttaaatgtaagctttaacttaactttaagtggtttgagtgaagtcttctaaattacacataatcactggttctaaacttccagaaccattctgtttaattaaacattatattatatatatattattattgacatggttcagggttaccactgccagagcattgattcatgttaacttcatcctattaatactgtatcaccctgtattagcagaagccaatatttattatagtattcaactggtaaaaataatacatgatatccatgttgcagtttctcatataaagatatgttttctttagcctctgtaataaagataatcattttcccatcaacattttttaaggaatatatttcttctttcataagatagccattaaactatattaagtggtggtatattttaatatagtgcaaatcaaaccacatacaaaaaaaaactggttctagacacggacagtcacaggctgatataagaaggtatgtgtttctaagtctggtaaaggaagtgggtttagacaaagcaaaaatctagaaaggtttctttctcaaagcaaatgtgcataaagactcaaagggcaggtcaacgcagaatagcagccttgaatcactgccgaatcagcaagaacattgctgtccatggtcaccatctgtaatcactgtgcccaaatgtcagcatcttggctggctggtgtagctttatttttaaaaatattttttgtaatagtacacttgtgtttaacatagaatgttgacttagataaatgatgaggaagttataaataattggagtagcataactttattatttggaaataaaagtattatgtacatatattagtaaaatgaaatgcacctga

SEQ ID NO: 2522 - DNA, 1736 bp, Homo sapiens
cttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaagaccaatggaggcttgtctaagtactgcttggccaaaacatgtggttttattattcacagctattcaagtggggaaaaaagagaaacatgtccttaatcccattgtttactcaggaaatgcactttttaaatgtctttaaaaaactgagaaatatttcttgatatttgctttgtctaaacctacttccttcatcagaccatatagtgagcttcatgggagaattgagccccttctttttaatggaaatcactaattttggtattcaaacttacattttagaatgcaagtagtgtgtatttcactgtttagaagtcatatcttagggaattaaatttgtgataatctttttaattactgagaaggcaatttaaactgcttgaagtttgaatatgccttattacacatgcaaatttgattgttttaacaaggcaaataaaccataatcttatttatttccaagaatgcatattttaatacaattaaaaatgaattttcctgaatttaaatgtaagctttaacttaactttaagtggtttgagtgaagtcttctaaattacacataatcactggttctaaacttccagaaccattctgtttaattaaacattatattatatatatattattattgacat

SEQ ID NO: 2523 - DNA, 1675 bp, Homo sapiens
agagggctttctccgcatgcgcgggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatatg

SEQ ID NO: 2524 - DNA, 1677 bp, Homo sapiens
agcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagacggagtttcacccttgttgcccaggctggagtgcaatggcacgatctcagctaactgaaacctccgcctcccagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttag

SEQ ID NO: 2525 - DNA, 2345 bp, Homo sapiens
gctgcccccgggagggtcttagctgtggcgcgcggggctcagtccggcctggcctcaccgcgggaggcccgagctccctcttcagctaggtcctattggtcttcctgggcgggtcagcattcagtcttcgcccaccttagatccctccactgcgctgtaaaactgccttggagtgcggatctgtgatgctcctgggccaggcctagagtgggcacagcctctgtgggagatgtagacaggatcaaagagtataccttttacggctgttcctcacagctccttttattctccctcaagtcccgaccctttactgggcccatccaacccgccatcacctcttcccaaaccctggaggctgcaggttagaactgcattaagggagctgtcaacatatggaattggagtaggctatgtaccttgcacctaggcttctatctgaacataagggggaatgaataaagccatcaaaagcaatgaccttgttaagaaaagaaagaaaaggagaatgacagctttgtggccttcaagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaa

SEQ ID NO: 2526 - DNA, 2935 bp, Homo sapiens
gtgacctcatgcaggtgtgatgaagtcgctcaaggccatgcttgggctaaagacactttgatcttcccgagggggtgaaagggcgaggtgacaggaaagtgcgcgtcttgcttttgcactcatagttatcatccaccggggagtcggtacaccggctcgtctagacaaccaggcgccatgggtgcgtcatcaactagtgacgggagaagacggggcggagagagatccgtgaaggaagtgacgtaaaacgagcgccacagagaacgcgagccgggagtccgtggaggccatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaatttgatcaaatttatttcatcttcccgcattgtggacgcaaagctggcgtagctaagaacagggaactgcttgccaaatttttccaaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatg

SEQ ID NO: 2527 - DNA, 1930 bp, Homo sapiens
tgaacataagggggaatgaataaagccatcaaaagcaatgaccttgttaagaaaagaaagaaaaggagaatgacagctttgtggccttcaagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagcacagttttctgtacttccagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaa

SEQ ID NO: 2528 - DNA, 2863 bp, Homo sapiens
atccggaagttgcctctgccctcaccaaagatggcggccccggcgccgctcgcccacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtaccttgaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgt

SEQ ID NO: 2529 - DNA, 1097 bp, Homo sapiens
aatcgcggaaaccgccggtgcacgttggagtcataagacggcgtcggtgttgcagtctgtgtccttggaggtgaccagggccactgcaggcatggtgctaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagtaagtatgcattcgtcagcttttgcaaagaatatgttttttgccgttttgaaacttgaatagtggtgctcacgatagcattgatttattccttctttgcatttgaacaggttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtcca

SEQ ID NO: 2530 - DNA, 1608 bp, Homo sapiens
gttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattca

SEQ ID NO: 2531 - DNA, 937 bp, Homo sapiens
ggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaagtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctg

SEQ ID NO: 2532 - DNA, 2519 bp, Homo sapiens
gtagcgtgatgacgtaagcggcgttggcgtggtgtggtaggagtggttgcgcgtgttgcggcccgggttctgttcgtaggtttacaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaaattttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagacacctatgg

SEQ ID NO: 2533 - DNA, 2904 bp, Homo sapiens
agggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctct

SEQ ID NO: 2534 - DNA, 1561 bp, Homo sapiens
cgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaagaaaatggtactcctcattcttgtagtcagctacaaagtacactgaaaatgatgttcttggtggtataattggtttctgtatcgttttgtttcaactcatgtattcactgaactaaatttggacacttaacagcaaattgtgttgtggttaacccttgatgcttgtctttctaacacactattaattatgatgattctaatggatttcattataaaaatatttctggcatgatttttaagttaaatgcttctctgttctttaacatgactgatgtataaaatgatggttctttactaagctgatattttttattgtaatttgtttaggtttgtcagataggttcatacaaatttctatgtaaaattctgtgttaatggtgcttttaaaataatttaaaaataactccatgtttttgccttagagtaagttaacttactgttttcagatagtagcatgacatatttctgtctgtgaaagcaaaatttattttaaattttatttccaaatatacatccagagaaagtaatttgtattttttttaaagtaggcatattacacaagagggaacatgtgaat

SEQ ID NO: 2535 - DNA, 4595 bp, Homo sapiens
cgcagccggcaggcgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattca

SEQ ID NO: 2536 - DNA, 1290 bp, Homo sapiens
ctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgtttttctctttcgtggacacctccccaggctcatgtgccaccaccttccctcctctccagccctcccagccctcccgcagccttt

SEQ ID NO: 2537 - DNA, 5292 bp, Homo sapiens
ggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttca

SEQ ID NO: 2538 - DNA, 2273 bp, Homo sapiens
cctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagc

SEQ ID NO: 2539 - DNA, 1947 bp, Homo sapiens
cctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaa

SEQ ID NO: 2540 - DNA, 2658 bp, Homo sapiens
tgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtgga

SEQ ID NO: 2541 - DNA, 2744 bp, Homo sapiens
ccgggcgcgcgcagccggcaggcgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattc

SEQ ID NO: 2542 - DNA, 842 bp, Homo sapiens
catgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagcc

SEQ ID NO: 2543 - DNA, 1258 bp, Homo sapiens
cagtctcaagctctggtaggcaagtgcatgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgtt

SEQ ID NO: 2544 - DNA, 5153 bp, Homo sapiens
tttcagttctagaggcccttacagtgcagggattggccagtctcaagctctggtaggcaagtgcatgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttc

SEQ ID NO: 2545 - DNA, 2172 bp, Homo sapiens
gcagcagttgagtccatgtaagatgattgtgcacgtgtgtgtgtgtgtgtgtgtgtgtgtgtgtgtcctcactcacttaaaaaagaccatttctgtgcattctttatgctggaaccctcctctgcctccctctccaggaaatcccataggatcccatacctgctttagaatgtgtgtgagacacttcccagtgcctggcatgtggtaggagctcagtacatgtaaactgttttcctttgaccactcaaagtagtcacttgttggggaggccaatggcggcttccccggtctctgagctgatgggcgtctggtccctgcctccccttccttcactggctgatgacaaatacctgaatgtcatcacatcctccgtgtcctcatctgttattctggaacacaggccagggagggtacagggtagtcccccttcaacagaggctggcctttcttgggatgtgggctggctggtgttggtccaaggatggatgcagagggtgaggcacccatcctgctagtccggccggatgctggcaggagggcggggtgaggaggggcggagcttccagaacaaaggagaatggggagcccaggggccagcctaggcatcaaaaaggctctgcagagtgaacaggccacagcactgcctgcctctgccccagcagtcagccagccgaccgcgcctgctccctcctgcttgcccaaggccgggcaagtcatccccactctgcttcgagaggccccgttttccagcgtgattgcgccgacactgctctgtgggtttctcttcttggcgtgggttgctgctgaggttccagaggagagcagcaggatggccgggagcggagccaggagtgaggaaggccgccggcagcatgccttcgtcccggaaccttttgatggggccaatgtcgtcccaaacctctggctgcacagctttgaagtcatcaatgacctcaaccattgggaccatatcaccaagctaaggttcctgaaagagtccctcagaggagaggccctgggtgtctacaataggctcagtccccaggaccagggagactatgggactgtgaaagaggccctcctgaaggcctttggggtccctggggctgcccccagccacctgcccaaagagatcgtctttgccaacagcatgggtaagggctactatctcaaggggaagattggcaaagtgcccgtgaggttcctggtggactctggggcccaggtctctgtggtccacccaaacttgtgggaggaggtcactgatggcgatctggacaccctgcagccctttgagaatgtggtaaaggtggccaatggtgctgaaatgaagatcctgggtgtctgggatacagcggtgtccctaggcaagctgaagctgaaggcacagttcctagtggccaatgcgagtgccgaggaagccatcattggcactgatgtgctccaggaccacaatgctatcctggactttgagcaccgcacatgcaccctgaaagggaagaagtttcgccttctgcctgtgggagggtccctggaagatgagtttgacctggagctcatagaggaggacccctcctcagaagaagggcggcaggagctatcccactgagaagccaccttttctttaacctcctaaatattggtgggaagacccaccgctgtggggggggttgcatatcctcatgggggtcactgggcttggccagtctgcttatcaactcttgctcttctctcccctttgcctccctctgcaggggccttaatctgcccctggtaggggaggcttccactgaacaggcacaggtgagggagagcaggctggcttagagggacagggtccccatggtcatcaagctgctgttgatgacaaagactcaaaggctggaagagctcccaaggaagctagaaatgcttgtctttgaaagaactgtgggaccccttcagattccctgaggtatggcttggtcactctcaggtcctcaaagcctgtcttagttgggctgggtcctagctgcagggtctttgtgagggtcacagttgctctgggacacctccctgaagagcctttccacctgtacaatcgtattttctttctgtcatttgctttgaagcccattgtgccttatgccaataattcaattgctgcaaacaccaataaagattgattcatgg

SEQ ID NO: 2546 - DNA, 1300 bp, Homo sapiens
cggagtgacagccccacgggccacgcagcaagcagaagatccccgggagtcaccctcaaccctctggggccacgtgggcccatgaataccagcctgtctgcgagttagacgccagtcctggtggcccgggaagcccagatccgcatcagcggttctgcaccccacaccagcatgtgctcactgcctgtgccccgggagcccctgcgtcgcgtggctgtgactgggggcacgcatggcaacgagatgtcgggcgtctacctggcccggcactggctgcatgcccccgcagagctgcagagagccagcttctccgctgtgcctgtgctggccaacccggcagccacatccggctgccgccgctacgtggaccatgacctcaaccgcaccttcaccagcagcttcctcaattccaggcccaccccggacgacccatatgaggtgacaagagcccgagagctgaaccagctgctggggcccaaggcctcgggccaggcctttgactttgtccttgacctgcacaacaccacggccaacatgggcacctgcttaatcgcgaagtcctcccacgaagtctttgccatgcacctgtgccgccatctgcagctgcagtaccccgagctgtcctgccaggtcttcctgtaccagcggtctggggaggagagctacaacctggactctgtggccaaaaatggactgggtctggagctgggcccccagccacagggtgtgctgcgggctgacattttctcaaggatgaggaccctggtggccacagttctggacttcatcgaactcttcaaccagggtacggcctttcctgcctttgagatggaagcctatagacccgtgggcgtcgtggacttcccccgcaccgaggccgggcacctggcaggcactgtgcatcctcagctgcaggaccgagacttccagccactgcagcctggtgctcccatcttccagatgttcagtggggaggacctgctctatgagggagagtccacggtgtaccccgtgttcattaacgaggctgcctactatgagaagggcgttgcctttgtccagactgagaagttcacattcaccgtgcctgccatgcccgcgctgacccctgccccgagcccagcttcctaacccaagacacacctccccaacctcagtcttcccatctgaacgatgggtcctgaggcacagctctgagcacagaggtcccttctgccacctaccatgcaccatgttccttgccaggcctccccaacccctggcctcaatttccctttctataaaatggaagatgtccaga

SEQ ID NO: 2547 - DNA, 2107 bp, Homo sapiens
agggacgcctgagcgaacccccgagagagcgggcgtgggcgccaggcgggcggggcactggggattaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccactgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattggcatggttgtaatccataagacaggacatattgctgctggtacatctacaaatggtataaaattcaaaatacatggccgtgtaggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttccagaattctttggggctgttatatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgatatattaaacccaaaaggaatcatcatatttggatgcttaaaatagagtatacaagttttttagacccaaagaaaaaaacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaaacttt

SEQ ID NO: 2548 - DNA, 3237 bp, Homo sapiens
tagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccagaattcagtagctttgttgtccggaccaacacatgtggagagttgcgttcgtctcacttaggccaagaagtcaccttgtgtggatggattcagtaccgaaggcaaaacacattcttggtcctaagagatttcgatgggcttgttcaagttatcattccccaggatgagtcggcagcctctgtgaagaagattttatgtgaagcccctgtggaatctgtggtgcaagtgtctggtacagtcatttcccgtcctgcaggacaagagaatccaaaaatgccaacaggtgagattgaaatcaaagttaaaacagctgagcttctgaatgcctgcaagaagctgccctttgaaattaagaacttcgtgaagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctggaaagttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatc

SEQ ID NO: 2549 - DNA, 3506 bp, Homo sapiens
cacttaaccactatcgtcaacctttccaatcgtgctcggttgctcctcagttttcctaccggtgcgaagctttctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccagaattcagtagctttgttgtccggaccaacacatgtggagagttgcgttcgtctcacttaggccaagaagtcaccttgtgtggatggattcagtaccgaaggcaaaacacattcttggtcctaagagatttcgatgggcttgttcaagttatcattccccaggatgagtcggcagcctctgtgaagaagattttatgtgaagcccctgtggaatctgtggtgcaagtgtctggtacagtcatttcccgtcctgcaggacaagagaatccaaaaatgccaacaggtgagattgaaatcaaagttaaaacagctgagcttctgaatgcctgcaagaagctgccctttgaaattaagaacttcgtgaagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctggaaagttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggcccgtagccaacactatgacttggttttaaatggcaatgaaataggaggtggttcaattcgaattcacaatgcagagctgcagcgttatatcctggcaaccttactaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatcaa

SEQ ID NO: 2550 - DNA, 2470 bp, Homo sapiens
agtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagcgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaataaaa

SEQ ID NO: 2551 - DNA, 973 bp, Homo sapiens
agtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaagtaaatctgccacaattt

SEQ ID NO: 2552 - DNA, 568 bp, Homo sapiens
agtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccattgatactcgaatgcttgatc

SEQ ID NO: 2553 - DNA, 2237 bp, Homo sapiens
agtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagcgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaataaaa

SEQ ID NO: 2554 - DNA, 7116 bp, Homo sapiens
ggccggggctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggaaagctggtctcatcctttcccagcttggggacctcagcagttggtgcaatggactccttcaggaacccaagataagcttgcggcgcagctcactcaagtacctggggtgccgctacagcgagatcaaaccctacggacttgactgggcggagctcagccgggacctcaggaagacgtgtgaggagcagaccctgagtatcccctacaacgactatggggacagcaaagagatctagcaccataaggccagggagctgctgccagaatgaagtaggaaagaggagggatccatctgggttggtctgtggatttttaatattttttaatggaacatgaaaacctccacagcaacatcgaaaccagggagaaagtgatccttgctccctgcagaacttcttcagtatgatgttctccatctgcatgattgggaaatctgccagccagtggcttcatgcagtgccatatttctttagaggattactttggggtttgctttgccattaatttgttccattcatttttttttccctgagaagtttaccaaaatgctcaagagctctgccgtgctccccatgaaaagtctattaagtaggcaccctgtgctcactcagttcctaaatccattgcaactgggagcagaggtgaggccagaaagttgttaggcctgccgcaggccccaccctcaagcattcctcaggaagcgtctcactctgggagccttggccctgctcacagagagagacaatagaaaattgaggaaggtggcccttgtctgtgtctcctggttttcttcctaggccttgctatcactatttccatacccgaaaggtgaaaccagctttcattataggccccagtgggccacttgggttttgagatccttccttattttaagccaggactgggattaaatctccctctgtcagatctctgtcccttcctctgaacaacatgatctttgagagggaacaagatgccatctgtcaactgcaccttcagaaaagtctacctgggagactagttagcagtccacattcaagaggagacttggagtttattgttttttaaaaaaaccatgcttcctttggatagacttctccagcctaccaatatatatccatgtgcctggattatctttaacccccacacctcttaccttggacaggtaaggcttggccgatgtctgattgggaccaggaggggtcaacactttcatatcagtgttacagtgaactaaagctattattgatcacaaaaaacttctgttcatccccaccttgctaaatttgcttgtgttgctagttttgcaaatcgtttctctgatgaccataagcaggaggattccaccatggtcactgcccatccagtcacagggattctgtgtagggaagcaccactgattgcagttaacatctagagtgttgtttccatcccactgcccaagcattggcatggtcatgaatggtggcccagccaacaggaagcccagcctttcagaaagagcctggcaaggccctgttgactagcaatggccttagctgtcccacacaactcagtggcctgaacacacaccttcagccaccatgcctttgaccagggctcctcatctggaaacatatgagaaaggtcagcaaacagatgcaagacctataaggctagtcattgagctatattggttttttttctaaatagtagtagtgacagataacatttattgagtgcttgctgtatgccaggcgctgatgtaagcactttaggtatcattgaattctcacagcaactcctgaggaaagtgctattcttgtctccattttagtgttgaggaaaacgaggcaaagagaggttatacaacttgcctcaaatcccttgtgcactgtaactcacactgagtttcagtgtgatttcaggctgttggtctccagggcacaggatcttagctactctgggatacccagttctgttttcagtatcatctggcacacaactgtccaagctctcagccccacagggaacctgcccagagagctttacctttcccaagcatctgtggcatggacatgtcctctgtgcagtggaaggaggaggggcgaaagtacgcccttagcctttggagctagagcacccttgggacccctagttccactgcacatggccctcctccccaccctcatgactgggaaggaagcctgtgatgaggctgagataaagcacagggtggtttcactctcctctctccttctttccaaacactgaaggatttatttcaaactctctaatgcacctgcctcagagattcccctactttcaaagcaaagatcagcagaaaaattggctgtcccacctgtggcaaatgctggagcctcagttaaagtgcctcaaggggcaaatatttcaccattgccagagaagatgtgacaggccaatcagacagggcccagagcatctctttgctgctactgttttgccatccttctattcatatctgtgcagaacacggtgttttaagcttgagtgaaaggagggtgaggctgccgatgccttcctgcccagaagtggatgatgtgggagttgacaggccagggagagggtgaagcaggtatcagagtcactcctctgtaccctctccttctgtttttattttaggcacactatcttcctctctcctatctttccctcagtctcccaagttcctctaccttctttatctttgtcttttacttcttctttctgtgaccctccttttttggcctcctctttccccaagactttcttcctcctgtttctcgttgagttctccccactgaatgtgtgtatgtatgtacacacacacacacgtgtgcacacacaatgcacacaactcctatgactggctcctacttacattcaagttaaaaaggctgatatgaacagggcaggggaaaatcttaggatggttgtacaattgactggaggattttttccccttggaagacactattgatctcaacctgctgacttttcctaatgcttacctgaaggaacccatcctggctagaaagggtgatggtactggaccggtattcaaccttgagttttcaagctgccaaacaggtcttaagggaggtgcttatatcccaccaacactctcccagctcccatgtccccaagacctctggagtttcctcttgaatgtacatgaaccactgtaatagcattagacttttaattgagtgtgcaatcgttttccatggagtttggtccgttcattattttttagttaactacacttcttgatattcaaatgttctattaaaaaaactgagtatgaagaaaaacactttactactgcagaaggaagaaagaatataatatgaccatcttcaggtataacagtgttgtttaaaagagaattattgtatgattataaaagatgaaataattaactgaataataaaacaaagctattagtaagca

SEQ ID NO: 2555 - DNA, 7122 bp, Homo sapiens
ggccggggctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggtaggcgggagcaccgggcagcgggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggaaagctggtctcatcctttcccagcttggggacctcagcagttggtgcaatggactccttcaggaacccaagataagcttgcggcgcagctcactcaagtacctggggtgccgctacagcgagatcaaaccctacggacttgactgggcggagctcagccgggacctcaggaagacgtgtgaggagcagaccctgagtatcccctacaacgactatggggacagcaaagagatctagcaccataaggccagggagctgctgccagaatgaagtaggaaagaggagggatccatctgggttggtctgtggatttttaatattttttaatggaacatgaaaacctccacagcaacatcgaaaccagggagaaagtgatccttgctccctgcagaacttcttcagtatgatgttctccatctgcatgattgggaaatctgccagccagtggcttcatgcagtgccatatttctttagaggattactttggggtttgctttgccattaatttgttccattcatttttttttccctgagaagtttaccaaaatgctcaagagctctgccgtgctccccatgaaaagtctattaagtaggcaccctgtgctcactcagttcctaaatccattgcaactgggagcagaggtgaggccagaaagttgttaggcctgccgcaggccccaccctcaagcattcctcaggaagcgtctcactctgggagccttggccctgctcacagagagagacaatagaaaattgaggaaggtggcccttgtctgtgtctcctggttttcttcctaggccttgctatcactatttccatacccgaaaggtgaaaccagctttcattataggccccagtgggccacttgggttttgagatccttccttattttaagccaggactgggattaaatctccctctgtcagatctctgtcccttcctctgaacaacatgatctttgagagggaacaagatgccatctgtcaactgcaccttcagaaaagtctacctgggagactagttagcagtccacattcaagaggagacttggagtttattgttttttaaaaaaaccatgcttcctttggatagacttctccagcctaccaatatatatccatgtgcctggattatctttaacccccacacctcttaccttggacaggtaaggcttggccgatgtctgattgggaccaggaggggtcaacactttcatatcagtgttacagtgaactaaagctattattgatcacaaaaaacttctgttcatccccaccttgctaaatttgcttgtgttgctagttttgcaaatcgtttctctgatgaccataagcaggaggattccaccatggtcactgcccatccagtcacagggattctgtgtagggaagcaccactgattgcagttaacatctagagtgttgtttccatcccactgcccaagcattggcatggtcatgaatggtggcccagccaacaggaagcccagcctttcagaaagagcctggcaaggccctgttgactagcaatggccttagctgtcccacacaactcagtggcctgaacacacaccttcagccaccatgcctttgaccagggctcctcatctggaaacatatgagaaaggtcagcaaacagatgcaagacctataaggctagtcattgagctatattggttttttttctaaatagtagtagtgacagataacatttattgagtgcttgctgtatgccaggcgctgatgtaagcactttaggtatcattgaattctcacagcaactcctgaggaaagtgctattcttgtctccattttagtgttgaggaaaacgaggcaaagagaggttatacaacttgcctcaaatcccttgtgcactgtaactcacactgagtttcagtgtgatttcaggctgttggtctccagggcacaggatcttagctactctgggatacccagttctgttttcagtatcatctggcacacaactgtccaagctctcagccccacagggaacctgcccagagagctttacctttcccaagcatctgtggcatggacatgtcctctgtgcagtggaaggaggaggggcgaaagtacgcccttagcctttggagctagagcacccttgggacccctagttccactgcacatggccctcctccccaccctcatgactgggaaggaagcctgtgatgaggctgagataaagcacagggtggtttcactctcctctctccttctttccaaacactgaaggatttatttcaaactctctaatgcacctgcctcagagattcccctactttcaaagcaaagatcagcagaaaaattggctgtcccacctgtggcaaatgctggagcctcagttaaagtgcctcaaggggcaaatatttcaccattgccagagaagatgtgacaggccaatcagacagggcccagagcatctctttgctgctactgttttgccatccttctattcatatctgtgcagaacacggtgttttaagcttgagtgaaaggagggtgaggctgccgatgccttcctgcccagaagtggatgatgtgggagttgacaggccagggagagggtgaagcaggtatcagagtcactcctctgtaccctctccttctgtttttattttaggcacactatcttcctctctcctatctttccctcagtctcccaagttcctctaccttctttatctttgtcttttacttcttctttctgtgaccctccttttttggcctcctctttccccaagactttcttcctcctgtttctcgttgagttctccccactgaatgtgtgtatgtatgtacacacacacacacgtgtgcacacacaatgcacacaactcctatgactggctcctacttacattcaagttaaaaaggctgatatgaacagggcaggggaaaatcttaggatggttgtacaattgactggaggattttttccccttggaagacactattgatctcaacctgctgacttttcctaatgcttacctgaaggaacccatcctggctagaaagggtgatggtactggaccggtattcaaccttgagttttcaagctgccaaacaggtcttaagggaggtgcttatatcccaccaacactctcccagctcccatgtccccaagacctctggagtttcctcttgaatgtacatgaaccactgtaatagcattagacttttaattgagtgtgcaatcgttttccatggagtttggtccgttcattattttttagttaactacacttcttgatattcaaatgttctattaaaaaaactgagtatgaagaaaaacactttactactgcagaaggaagaaagaatataatatgaccatcttcaggtataacagtgttgtttaaaagagaattattgtatgattataaaagatgaaataattaactgaataataaaa

SEQ ID NO: 2556 - DNA, 3685 bp, Homo sapiens
gctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggtaatcaataaactaagtcaacccttttaaa

SEQ ID NO: 2557 - DNA, 3852 bp, Homo sapiens
catcagagcttaaacccaggactctgcaagcggcatctcattccggggtccagggctctcccggctctccatcccctccctaacctcccccgcctcccgcgctcgctccctcgctccctccccgctcgcttcctcccccaccatcgcagcgctaggaggaaggcggccggggctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggaatcaataaactaagtcaaccctttt

SEQ ID NO: 2558 - DNA, 2356 bp, Homo sapiens
ccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcagtaagtcaggagataagccagaatgcgtatctgactccagtctcaatgtctaccccttcacaaaacggtagcctccagggtagtcctcagcaaagcgttggcaccttactgaatctgtttttccatctgagaaatgggccaacggaaaaatcaaacttccattctggggaagtcgagaaccgggactccctaggaagggcagtgctttggcctcatgttctgtgctctgacagagagctgcactagagacaagtttatccatgaacacattgctctgtaaaggaatgttttgcctactcagctgggaggccgacagcagaggcagacttggggagtacactctgcagcccctgtccctgcagactgaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 2559 - DNA, 4747 bp, Homo sapiens
ggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaagcagcagctgaggcgactcaggagacagtggagtccctgatgcagaagttcaaggagagtttccgcgctaacacgcccatcgagatcggtcagctgcaaccacccctgcgcagcacatcggcagggaagaggaagcggaggagcaagtctcgaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctcttt

SEQ ID NO: 2560 - DNA, 1757 bp, Homo sapiens
gcttgtcgtgcagctggccccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcaagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 2561 - DNA, 3411 bp, Homo sapiens
ctggccccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcaagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacagtttattgctggattacatttattgatttgcggatattgaaccagccttgcatcccagggatgaagccaacttgattgtggtggataagctttttgatgtgctgctggatttggtttgccaatattttattgaagatttttgcatcgatgttcatcagggatattggtctaaaattctctttttttgttgtgtctctgccaggctttggtatcaggatgatgttggcctcataaaatgaattagggaggattccctctttttctattgatttgaatagtttcagaaggaatggtaccagctcatctttgtacctctggtagaattcggctgtgaatccatctggtcctggacttattttggttagtaggctattaattatggcctcaatttcagaacctgttattggtctattcagggattcaacttcttcctggtttagtcttgggaggaggctgtatgtgtccaggaatttatccatttcttctagattttctagtttatttgcatagaggtgtttatagtattctctaatggtagtttgtatttctgtgggatcggtggtgatatcccctttatcattttttattgcgtctatttgattcttctctcttttattctttatgagtcttgctagtagtctatcaattttgttgattttttcaaaaaaccagctcctggattcattgattttttgaagggtttttttttttttgtctctatctccttcagttctgctctcatcttagttatttcttgccttctgctagcttttgtgtgtttgctcttgcttctctagttcttttaattatgatgttagggtgtcagtttcagatctttcttgctttctcctgtgggcatttagtgctataaatctccctctacacactgctttaaatgtgtcccagagattctggtatgttgtgtcctgttctcattggtttcaaagaacatctttatttccgctttcatttcgttatgtacccagtagtcattcaggagcaagttgttcagtttccatgtagttgagcggttttgagtgagtttcttaatcctgagttctagtttgattgcactgtgttctgagagacagtttgttataatttctttcttttacatttgctgaggagtgctttacttcccactgtgtgatcaattttggaataactgcgatgtggtgctgagaagaatgtatattctgttgattggggtggatagttctgtagatgtctattaggtccgcttggtgcagagctgagttcaattcctggatatccttgttaactttctgtctcattgatctatctaatgttgacagtggggtgttaaagtctcccattattattgtgtgggagtctaagtctctttgtaagtctctaaggacttgctttatgaatctgggtgctcctatattgggtgcatatatatttaggatagttagctcgaagaaggtatcttctatttctagtctgctgcaaaggctctgttttgtttccattggaaacagatgttgaattttctgtgtctattaaaatgattgtatagtttatctctctaaatttgttaatatgataagtcacattgatagattttcatattataaaacaacctactatgtgagatttatcccaggaatgtgtaggttgttttatctgtttgttttaattaggatcattctggtctcacaaaatgaattataaaatattttctccttttcagttttctgaagtgtatctgtcttctcagagaatcactgtggttaaaattgatagtatttttttcttaatcattttttagaattcaccagtgaaggcatctgggcttagaccttttcttgcaagaaggtttttaactactaatttagttatttaatagatatagatttacttagattatctgtttcttcttgagtgatctttggcagcttgtgtgttttaaggaacttgttcattccatgtaaattatcaaatttattggaaaaagttgtttatgacattccgttactattcttttgaaatctgttgagattatagtgatattagtctcatcttgatattggtaatgtgtgtctcctctgttttttttctagatcagtttggctagatagctatgacatttatttgtattttcaaagaatcaactttcggttttatctgtttttgcttattgtttcctatttcattgatttatcctctaatttttattataattttctttgtttggcttactttgagtttggttttctccgcattttaatttttgaaatggtagctgaggctattgatttgagacctttcttgtaatgtagtcattccctcttaactactgctttagtagtatctcaaagattgtgttatgttgcgttttcattttcattcagttcaaagtatttccaatttcacttttgttttcttctttgacttatgagttatttagaggcatgccacttcgttttcaaatatttgggagttttttcagaaatttttgttgttgatttttgattccgctatagtcagaaaatatgtttttatgactttaaacattttaaatttattgagactagtttttggtctagatggtctattgctgtattcagtgttcactttaaaataatgtgtatccacttatttatgggtattttataaatgcctgttagataaaatcggttaattatgttattcaagtcttctggagcctttctgattttct

SEQ ID NO: 2562 - DNA, 4622 bp, Homo sapiens
ggctctctccgctccttagctcgggcgtcctggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 2563 - DNA, 3980 bp, Homo sapiens
ggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacatattatttgactctatcaaaagtctctcctttttaa

SEQ ID NO: 2564 - DNA, 4634 bp, Homo sapiens
atggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaagcagcagctgaggcgactcaggagacagtggagtccctgatgcagaagttcaaggagagtttccgcgctaacacgcccatcgagatcggtcagctgcaaccacccctgcgcagcacatcggcagggaagaggaagcggaggagcaagtctcgaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctcttt

SEQ ID NO: 2565 - DNA, 395 bp, Homo sapiens
agatggcctacaacacactgatggaggtctcagcctcgatgctgttccgagtccagcaccactacaactctcactatgaaaagtttggcgacttcgtctggagaagtgaggatgagctggggcccagcctcctggaatcctttatgagcctccaggacataaatcttctggaaaggcggccgggccgcccacagaggccaggcaatccactcagtaatgtctcctggaggatatctgagattgctccaacatcccacactgatatgtcagcaggaatcaaggaaactgcctcctaatctatcctggtgctgctaataagctcactgtgcaaccctgggctctgccgctttctggccctcagtctcctcacctataacatgataaggacgaactag

SEQ ID NO: 2566 - DNA, 8633 bp, Homo sapiens
tggggctcgagggggcgagcggtggcggtggcgggtacggcaggctcgcgggcgccgggcttcgttacataatctcggaccggaggagcggcggcacatggcggcggagcggcgctgtggaagtatgcgagacttaagagctcaagtgactagtggtctcctgccatttccagaagtgactcttcaagcccttggagaagacgaaataacattagaatctgtgcttcgtggaaagtttgctgcagggaaaaatggacttgcttgcttggcttgtggtccacaacttgaggtagtaaactctataacaggagagcgattgtctgcttacagattcagtggagtcaatgaacagcctcctgtagttttagctgtgaaagaattctcttggcagaagagaactggattattaataggattggaagaaacagaagggagtgttctctgtctttatgaccttggaatatcaaaagtagttaaagcagttgttcttcctggaagggtaacagctattgaacctataattaatcatggaggagccagtgcaagcactcagcatttacatccaagtctgcgatggctttttggagtggcagctgtggtcactgatgttggacagatccttcttgttgacctatgtttggatgacttgtcatgcaatcaaaatgaagttgaagcatcagatcttgaagttctaactggtatcccagctgaagtaccacacattagagaaagtgtaatgagacaagggcgccatctgtgtttccagttagtaagtccaacaggaacagctgtttcaactcttagttacataagcaggacaaatcagcttgctgtaggtttttctgatggctatctagcactttggaacatgaaaagcatgaaaagagaatattacatacaattggaaagtggacaagttcctgtatatgctgtcacttttcaagaacctgagaatgatcctcggaattgctgttacttgtgggctgttcagtctacacaagatagtgaaggggatgttttgagtttgcatctgctgcagctggcctttggtaatagaaagtgtttggcatcaggacaaatcttatatgaggggttagaatactgtgaagaaagatacaccctggacctgacaggtggcatgttccctttgaggggacagacgagtaataccaaattgttgggatgccagagtatagagaaatttcgatctcatggtgacagggaggaaggcgtgaatgaagctctatcgcctgacactagtgtttcagtctttacctggcaggtgaatatatatggacagggaaagccttctgtatatttggggctttttgatataaatcgttggtatcatgcacaaatgccagattcgttaaggtcaggagaatatctacataattgctcttattttgcactgtggtcattggagtctgttgtaagtaggacttctccacatggcatcttggatatattagtacatgagagaagtttaaatagaggagtccctccttcatatccacctcccgagcagttttttaatccaagcacttataattttgatgccacttgtttgttaaactcgggagttgttcatttaacttgtactggctttcagaaggagactttgacttttttaaagaaatcaggtccatcactcaatgaactcattcctgatggttataatcgatgtcttgtagctggccttctttccccaagatttgttgatgttcagccttccagtttaagccaagaagaacagttagaagctatattgtcagcagcaattcagactagttccctgggacttttgactggttatatccgaagatggataacagaagaacaaccaaattctgccactaatttgcgctttgttcttgaatggacgtggaataaagtggttctcacaaaagaggaatttgacagactatgtgtgccattatttgatggttcgtgtcatttcatggatccacaaactatacagtctatccagcaatgctatttgcttcttagcaatcttaatatagtcttgagctgttttgcatcagaagcccgagagatcactgagagaggactgatagacttaagcaataagtttgtggtttcccacctcatctgtcagtatgcacaagtggttctttggttctctcattctgggcttttaccagaaggcatagatgattctgtgcagttgtcaaggttatgctacaactaccctgtaattcagaactactacaccagtcgtcgacagaagtttgagcgtttatcaagagggaagtggaatcccgattgcttgatgattgatggactggtttctcagttaggagagcgaattgagaagttgtggaaacgagatgaaggaggcacaggaaaatatcctcctgctagtctgcatgcagtacttgatatgtacctattagacggcgttactgaagcagccaaacactctattaccatttatttgctacttgatattatgtattcctttcccaacaaaacagacactcccattgaatctttcccaactgtatttgccatttcttggggccaagttaaacttattcaggggttttggttgatagatcataatgactatgagagtggtttggatcttttgtttcatccagctactgcaaaacctttgtcatggcaacattcaaagattattcaggcattcatgagtcagggcgagcacagacaagccctcagatatattcagacaatgaagccaacagtgtccagtggtaacgatgttatccttcacctcactgttttgctttttaataggtgtatggttgaagcctggaattttttgcggcaacattgcaataggttgaatatagaggagttactgaagcacatgtatgaagtctgtcaggaaatgggcttgatggaagatttactgaagttaccatttacagacactgagcaggaatgtttagtgaaatttttgcagtccagtgccagcgttcagaatcatgaattccttttagtgcaccatttgcagcgtgccaattatgtgcctgccttgaagctgaaccaaactctgaagattaatgttatgaatgatcgtgatcctcgtttgcgggagagatcactggctcgaaattctatattagaccagtatggaaaaatccttcctagagtccatcgaaaattagccattgaacgagctaagccttatcatctgtcaacatcatcagtttttcgattagtttctagacccaaaccattatcagcagttccaaagcaagttgtaacaggaactgtgttgacaagatctgttttcatcaacaatgtgttatctaaaattggagaagtttgggcaagcaaagaacctataaatagcaccacacctttcaatagttctaaaatagaagaaccatctcctatagtgtattcgctcccagctccagagctgcctgaggcattttttggaacaccaatttcaaaagcatcacaaaaaatttctagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttccaatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcattaaaa

SEQ ID NO: 2567 - DNA, 8751 bp, Homo sapiens
tcgttacataatctcggaccggaggagcggcggcacatggcggcggagcggcgctggtggttcgcgtcctgcgccggcagtcgggtccctttacggacggccggggccgcgaccctttcccactgttctcccacgcgatggactcgttggcgggcctttccccgagggaagcggccggcgtgctgagcctgtcctgtgttggcgtgtgttccacatgcgcttgggcctggccacatggaagtatgcgagacttaagagctcaagtgactagtggtctcctgccatttccagaagtgactcttcaagcccttggagaagacgaaataacattagaatctgtgcttcgtggaaagtttgctgcagggaaaaatggacttgcttgcttggcttgtggtccacaacttgaggtagtaaactctataacaggagagcgattgtctgcttacagattcagtggagtcaatgaacagcctcctgtagttttagctgtgaaagaattctcttggcagaagagaactggattattaataggattggaagaaacagaagggagtgttctctgtctttatgaccttggaatatcaaaagtagttaaagcagttgttcttcctggaagggtaacagctattgaacctataattaatcatggaggagccagtgcaagcactcagcatttacatccaagtctgcgatggctttttggagtggcagctgtggtcactgatgttggacagatccttcttgttgacctatgtttggatgacttgtcatgcaatcaaaatgaagttgaagcatcagatcttgaagttctaactggtatcccagctgaagtaccacacattagagaaagtgtaatgagacaagggcgccatctgtgtttccagttagtaagtccaacaggaacagctgtttcaactcttagttacataagcaggacaaatcagcttgctgtaggtttttctgatggctatctagcactttggaacatgaaaagcatgaaaagagaatattacatacaattggaaagtggacaagttcctgtatatgctgtcacttttcaagaacctgagaatgatcctcggaattgctgttacttgtgggctgttcagtctacacaagatagtgaaggggatgttttgagtttgcatctgctgcagctggcctttggtaatagaaagtgtttggcatcaggacaaatcttatatgaggggttagaatactgtgaagaaagatacaccctggacctgacaggtggcatgttccctttgaggggacagacgagtaataccaaattgttgggatgccagagtatagagaaatttcgatctcatggtgacagggaggaaggcgtgaatgaagctctatcgcctgacactagtgtttcagtctttacctggcaggtgaatatatatggacagggaaagccttctgtatatttggggctttttgatataaatcgttggtatcatgcacaaatgccagattcgttaaggtcaggagaatatctacataattgctcttattttgcactgtggtcattggagtctgttgtaagtaggacttctccacatggcatcttggatatattagtacatgagagaagtttaaatagaggagtccctccttcatatccacctcccgagcagttttttaatccaagcacttataattttgatgccacttgtttgttaaactcgggagttgttcatttaacttgtactggctttcagaaggagactttgacttttttaaagaaatcaggtccatcactcaatgaactcattcctgatggttataatcgatgtcttgtagctggccttctttccccaagatttgttgatgttcagccttccagtttaagccaagaagaacagttagaagctatattgtcagcagcaattcagactagttccctgggacttttgactggttatatccgaagatggataacagaagaacaaccaaattctgccactaatttgcgctttgttcttgaatggacgtggaataaagtggttctcacaaaagaggaatttgacagactatgtgtgccattatttgatggttcgtgtcatttcatggatccacaaactatacagtctatccagcaatgctatttgcttcttagcaatcttaatatagtcttgagctgttttgcatcagaagcccgagagatcactgagagaggactgatagacttaagcaataagtttgtggtttcccacctcatctgtcagtatgcacaagtggttctttggttctctcattctgggcttttaccagaaggcatagatgattctgtgcagttgtcaaggttatgctacaactaccctgtaattcagaactactacaccagtcgtcgacagaagtttgagcgtttatcaagagggaagtggaatcccgattgcttgatgattgatggactggtttctcagttaggagagcgaattgagaagttgtggaaacgagatgaaggaggcacaggaaaatatcctcctgctagtctgcatgcagtacttgatatgtacctattagacggcgttactgaagcagccaaacactctattaccatttatttgctacttgatattatgtattcctttcccaacaaaacagacactcccattgaatctttcccaactgtatttgccatttcttggggccaagttaaacttattcaggggttttggttgatagatcataatgactatgagagtggtttggatcttttgtttcatccagctactgcaaaacctttgtcatggcaacattcaaagattattcaggcattcatgagtcagggcgagcacagacaagccctcagatatattcagacaatgaagccaacagtgtccagtggtaacgatgttatccttcacctcactgttttgctttttaataggtgtatggttgaagcctggaattttttgcggcaacattgcaataggttgaatatagaggagttactgaagcacatgtatgaagtctgtcaggaaatgggcttgatggaagatttactgaagttaccatttacagacactgagcaggaatgtttagtgaaatttttgcagtccagtgccagcgttcagaatcatgaattccttttagtgcaccatttgcagcgtgccaattatgtgcctgccttgaagctgaaccaaactctgaagattaatgttatgaatgatcgtgatcctcgtttgcgggagagatcactggctcgaaattctatattagaccagtatggaaaaatccttcctagagtccatcgaaaattagccattgaacgagctaagccttatcatctgtcaacatcatcagtttttcgattagtttctagacccaaaccattatcagcagttccaaagcaagttgtaacaggaactgtgttgacaagatctgttttcatcaacaatgtgttatctaaaattggagaagtttgggcaagcaaagaacctataaatagcaccacacctttcaatagttctaaaatagaagaaccatctcctatagtgtattcgctcccagctccagagctgcctgaggcattttttggaacaccaatttcaaaagcatcacaaaaaatttctagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttccaatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcattaaaa

SEQ ID NO: 2568 - DNA, 8629 bp, Homo sapiens
tggggctcgagggggcgagcggtggcggtggcgggtacggcaggctcgcgggcgccgggcttcgttacataatctcggaccggaggagcggcggcacatggcggcggagcggcgctgtggaagtatgcgagacttaagagctcaagtgactagtggtctcctgccatttccagaagtgactcttcaagcccttggagaagacgaaataacattagaatctgtgcttcgtggaaagtttgctgcagggaaaaatggacttgcttgcttggcttgtggtccacaacttgaggtagtaaactctataacaggagagcgattgtctgcttacagattcagtggagtcaatgaacagcctcctgtagttttagctgtgaaagaattctcttggcagaagagaactggattattaataggattggaagaaacagaagggagtgttctctgtctttatgaccttggaatatcaaaagtagttaaagcagttgttcttcctggaagggtaacagctattgaacctataattaatcatggaggagccagtgcaagcactcagcatttacatccaagtctgcgatggctttttggagtggcagctgtggtcactgatgttggacagatccttcttgttgacctatgtttggatgacttgtcatgcaatcaaaatgaagttgaagcatcagatcttgaagttctaactggtatcccagctgaagtaccacacattagagaaagtgtaatgagacaagggcgccatctgtgtttccagttagtaagtccaacaggaacagctgtttcaactcttagttacataagcaggacaaatcagcttgctgtaggtttttctgatggctatctagcactttggaacatgaaaagcatgaaaagagaatattacatacaattggaaagtggacaagttcctgtatatgctgtcacttttcaagaacctgagaatgatcctcggaattgctgttacttgtgggctgttcagtctacacaagatagtgaaggggatgttttgagtttgcatctgctgcagctggcctttggtaatagaaagtgtttggcatcaggacaaatcttatatgaggggttagaatactgtgaagaaagatacaccctggacctgacaggtggcatgttccctttgaggggacagacgagtaataccaaattgttgggatgccagagtatagagaaatttcgatctcatggtgacagggaggaaggcgtgaatgaagctctatcgcctgacactagtgtttcagtctttacctggcaggtgaatatatatggacagggaaagccttctgtatatttggggctttttgatataaatcgttggtatcatgcacaaatgccagattcgttaaggtcaggagaatatctacataattgctcttattttgcactgtggtcattggagtctgttgtaagtaggacttctccacatggcatcttggatatattagtacatgagagaagtttaaatagaggagtccctccttcatatccacctcccgagcagttttttaatccaagcacttataattttgatgccacttgtttgttaaactcgggagttgttcatttaacttgtactggctttcagaaggagactttgacttttttaaagaaatcaggtccatcactcaatgaactcattcctgatggttataatcgatgtcttgtagctggccttctttccccaagatttgttgatgttcagccttccagtttaagccaagaagaacagttagaagctatattgtcagcagcaattcagactagttccctgggacttttgactggttatatccgaagatggataacagaagaacaaccaaattctgccactaatttgcgctttgttcttgaatggacgtggaataaagtggttctcacaaaagaggaatttgacagactatgtgtgccattatttgatggttcgtgtcatttcatggatccacaaactatacagtctatccagcaatgctatttgcttcttagcaatcttaatatagtcttgagctgttttgcatcagaagcccgagagatcactgagagaggactgatagacttaagcaataagtttgtggtttcccacctcatctgtcagtatgcacaagtggttctttggttctctcattctgggcttttaccagaaggcatagatgattctgtgcagttgtcaaggttatgctacaactaccctgtaattcagaactactacaccagtcgtcgacagaagtttgagcgtttatcaagagggaagtggaatcccgattgcttgatgattgatggactggtttctcagttaggagagcgaattgagaagttgtggaaacgagatgaaggaggcacaggaaaatatcctcctgctagtctgcatgcagtacttgatatgtacctattagacggcgttactgaagcagccaaacactctattaccatttatttgctacttgatattatgtattcctttcccaacaaaacagacactcccattgaatctttcccaactgtatttgccatttcttggggccaagttaaacttattcaggggttttggttgatagatcataatgactatgagagtggtttggatcttttgtttcatccagctactgcaaaacctttgtcatggcaacattcaaagattattcaggcattcatgagtcagggcgagcacagacaagccctcagatatattcagacaatgaagccaacagtgtccagtggtaacgatgttatccttcacctcactgttttgctttttaataggtgtatggttgaagcctggaattttttgcggcaacattgcaataggttgaatatagaggagttactgaagcacatgtatgaagtctgtcaggaaatgggcttgatggaagatttactgaagttaccatttacagacactgagcaggaatgtttagtgaaatttttgcagtccagtgccagcgttcagaatcatgaattccttttagtgcaccatttgcagcgtgccaattatgtgcctgccttgaagctgaaccaaactctgaagattaatgttatgaatgatcgtgatcctcgtttgcgggagagatcactggctcgaaattctatattagaccagtatggaaaaatccttcctagagtccatcgaaaattagccattgaacgagctaagccttatcatctgtcaacatcatcagtttttcgattagtttctagacccaaaccattatcagcagttccaaagcaagttgtaacaggaactgtgttgacaagatctgttttcatcaacaatgtgttatctaaaattggagaagtttgggcaagcaaagaacctataaatagcaccacacctttcaatagttctaaaatagaagaaccatctcctatagtgtattcgctcccagctccagagctgcctgaggcattttttggaacaccaatttcaaaagcatcacaaaaaatttctagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttccaatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcatt

SEQ ID NO: 2569 - DNA, 5562 bp, Homo sapiens
caataggagttcgtgtagaagcgagtctgctcaacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaaaaggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacagatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcatctcccccacaaaatgtacttgctgtagaatgcaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacaaaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgtaaaatgcacttttctgtcttttctttgcaaagcagaagtatctcaatgtaaaataaaaatggagctcagtgggcagtattaataaaggccatgttttaaac

SEQ ID NO: 2570 - DNA, 5891 bp, Homo sapiens
taagtggaagatgtcctacctgctgtttttctcaccaatccatgaagtttcacagctacatccaatgaggacggcaggtagcgaggtcctatccgaagctcttcggcgtcatgagcagccaataggagttcgtgtagaagcgagtctgctcaacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaaaaggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaagtaaatgtaccccagtaaagcatcttaatgtatctaagccacagaaacttgcacgatctcctgcaagaatatccccgcacatcaaagatggagagaaagataaacacagagaaaaacatccgaattcatcccctaggacatataaatggagctttcagctcaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcatctcccccacaaaatgtacttgctgtagaatgcaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacaaaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgtaaaatgcacttttctgtcttttctttgcaaagcagaagtatctcaatgtaaaataaaaatggagctcagtgggcagtattaataaaggccatgttttaaacata

SEQ ID NO: 2571 - DNA, 4051 bp, Homo sapiens
attgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaaaaggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcatctcccccacaaaatgtacttgctgtagaatgcaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctcttt

SEQ ID NO: 2572 - DNA, 582 bp, Homo sapiens
ggcgccgtgacactccgctgccgccaccgcgggcccggggcgggccgagggggccgagcggcggaggcggggcgcgggccgaagtcggggtatccgggggaccgcggagcggaggctcggcggtcgtctccgcgggggacctggggaagcccgaagggagctctggccttttccggagctatctgtcctggagctccgagttgagcattccgggtcaaagtggccagcgaggcgggggcgcggtgggccgctggcgagctccggggcggaacgggctgccctttggcgctcgtggggttctcgctgccccctcagctcctgcgtcctggctgccctcgtaaggggtcttgtcccttggctgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgacca

SEQ ID NO: 2573 - DNA, 5783 bp, Homo sapiens
attccgggtcaaagtggccagcgaggcgggggcgcggtgggccgctggcgagctccggggcggaacgggctgccctttggcgctcgtggggttctcgctgccccctcagctcctgcgtcctggctgccctcgtaaggggtcttgtcccttggctggtgaggattctgcccctccccgctggcgtttgtttactttctttcccttggtcgctccccgcagttgactgattatgtctgtgcctgtctttccccctccccatagttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaaaaggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacagatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcatctcccccacaaaatgtacttgctgtagaatgcaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacaaaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgtaaaatgcacttttctgtcttttctttgcaaagcagaagtatctcaatgtaaaataaaaatggagctcagtgggcagtattaataaaggccatgttttaaacataggctttatacttttagttttcatttaagtgattgcttttttcctaagtgcttgtaacttacagttggaaaatcagatttcacaaaaccaagcattttagtatattcagcctttacaataaaatatttctactaattataaaaatgaaaaaaaaa

SEQ ID NO: 2574 - DNA, 6067 bp, Homo sapiens
aaagggggggaacctagagtcggtgggggggaagcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatccttga

SEQ ID NO: 2575 - DNA, 5811 bp, Homo sapiens
agaaagggggggaacctagagtcggtgggggggaagcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatccttga

SEQ ID NO: 2576 - DNA, 5946 bp, Homo sapiens
ggcggggccagatgttgatctcgctcccacttgtcgggtctgagcccggaacgggacgtgggcaggggctctgtggcgggccggtcctgcccgcggcccacaggccctcctggcccctcggtggcccccggccggcctctcgctcggacgcggcgcgtgggggcgcggattcgctcggccgggcgccgaggccctaggggagagcggccggccctgcgccggacgccgggcttgttgtgagtttcttctctgacagaaatggcgtcattgtcgtagacgggaaactccgtcgggtctcgacaatggggacgggaagctgccgagctgtgtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatccttga

SEQ ID NO: 2577 - DNA, 3957 bp, Homo sapiens
aaagggggggaacctagagtcggtgggggggaagcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcattttaccccac

SEQ ID NO: 2578 - DNA, 1759 bp, Homo sapiens
ggtgggggggaagcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattct

SEQ ID NO: 2579 - DNA, 2463 bp, Homo sapiens
aaagggggggaacctagagtcggtgggggggaagcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaactccgtctacaaaaaaaaaaaaaaaaaaaagaataag

SEQ ID NO: 2580 - DNA, 2188 bp, Homo sapiens
agtatctcagagagcgcggggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgta

SEQ ID NO: 2581 - DNA, 1996 bp, Homo sapiens
atctcagagagcgcggggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatcc

SEQ ID NO: 2582 - DNA, 2548 bp, Homo sapiens
agagtcttgggccagtaaggagtgctccgcgggccccaggggaggacaacaggtgcctcttgccccacccgggctcctctggtgggagcccacacgcacggtggcgtcactgcgcctacaggcaacgctagagcacaggaggggtgggaggtcggggctcgagggcttcaccccgcagcagagctcagagcccaatccaggccttagggacccgcctggggcctagaacttggtgtggcagaggtagaaagggcctccgataatctgcttctacagttgagagacgtcaactggcacctctgagcctctgccccgtaggtgaaatgggaacacacgaaaccatctgaggagctctcactgtccgtcaccaccaaatgtggcccagactccgtggggagggacagtcccatcctggaactggggcttttaggacatcccagagcccgcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatcca

SEQ ID NO: 2583 - DNA, 7891 bp, Homo sapiens
atcagacgatatcccagacaggagcggttagagagagaggaatcacatctccacacagttttagggtgctttttatttttacaaatcttcttgtgtgttttttgccttgatccatcctcttcccgccgagatcgtatggcgcctttctctcgattatgaatttgatcaatccatctttggaagaaaacccacatagttttttcaggagctgaaaattgagtcgttatagaaatattaggacatattttcaatcatttcggtgcccgaagggaggcaagagctcagttttatattgagacattacgccggctgaaggcagagaatgcgtttccctgccaggacctgatgcaatccattcaagccaacaagtttggagagaatgttgagttcaatcaattcagaacgtcgagatggagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctgggggaggacgaggaagaaacgaacgtgatagttctcagctacccccagtactgccggtaccgctcgatgctgaaacgcatccaggataagccatcttccattctaacggaccagtttgcattggccctggggggcattgcagtggtcagcaggaaccctcagatcctgtactgtcgggacacctttgaccacccgactctcatagaaaacgagagtatatgcgatgagtttgcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatggctccccaccccctttgatcagcaaaaagaaactgattgctagggatgacttgtgttccagtttgtcccagacccaccatggccaaagcactgaccatatggcggtcagccggccatcagtgattcagcacgtccagagtttcagaagcaagccctcggaagagagaaagaccatcaatgacatctttaagcatgagaaactgagtcgatcagatccccaccgctgcagcttctccaagcatcaccttaacccccttgctgactcctacgtcctgaagcaagaaattcaggagggcaaggataaactcttagagaaaagggccctcccccattcccacatgcctagcttcctggctgacttctactcgtcccctcatctccatagcctctacagacacaccgagcaccatcttcataatgaacagacatccaaatacccttccagggacatgtacagggaatcggaaaacagttcttttccttcccacagacaccaagaaaagctccatgtaaattatctcacgtccctgcacctgcaagacaaaaagtcggcggcagcagaagcccctacggatgatcagcctacagatctgagccttcccaagaacccgcacaaacctaccggcaaggtcctgggcctggctcattccaccacagggccccaggagagcaaaggcatctcccagttccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgtttc

SEQ ID NO: 2584 - DNA, 3141 bp, Homo sapiens
agagccctccctgccagtctggcaactccagcaaagtcctcaggctcatcccacacactcggtgctagtcactgctgtgtgtttacatgagtaatggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatggctccccaccccctttgatcagcaaaaagaaactgattgctagggatgacttgtgttccagtttgtcccagacccaccatggccaaagcactgaccatatggcggtcagccggccatcagtgattcagcacgtccagagtttcagaagcaagccctcggaagagagaaagaccatcaatgacatctttaagcatgagaaactgagtcgatcagatccccaccgctgcagcttctccaagcatcaccttaacccccttgctgactcctacgtcctgaagcaagaaattcaggagggcaaggataaactcttagagaaaagggccctcccccattcccacatgcctagcttcctggctgacttctactcgtcccctcatctccatagcctctacagacacaccgagcaccatcttcataatgaacagacatccaaatacccttccagggacatgtacagggaatcggaaaacagttcttttccttcccacagacaccaagaaaagctccatgtaaattatctcacgtccctgcacctgcaagacaaaaagtcggcggcagcagaagcccctacggatgatcagcctacagatctgagccttcccaagaacccgcacaaacctaccggcaaggtcctgggcctggctcattccaccacagggccccaggagagcaaaggcatctcccagttccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatgg

SEQ ID NO: 2585 - DNA, 1564 bp, Homo sapiens
accccccaccccctcctccctgcacacaaaagcagcataaattaaccgtcttcgggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcctccagcccctgcacagatcaagctga

SEQ ID NO: 2586 - DNA, 1543 bp, Homo sapiens
accccccaccccctcctccctgcacacaaaagcagcataaattaaccgtcttcgggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagaatgtcc

SEQ ID NO: 2587 - DNA, 1957 bp, Homo sapiens
ctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccagccaggaattgctttgcacaatcctgggaaccaccaagtccaaaatccacagggcaggctggaaactgtcaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcctctgtggtcagagctggatacaagattcaagacccttctcttgcttgtcacccgctccaggttggag

SEQ ID NO: 2588 - DNA, 5032 bp, Homo sapiens
accccccaccccctcctccctgcacacaaaagcagcataaattaaccgtcttcgggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcctctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctcaaaaaaaataaaaaataatcagggcacagtggctcatgcctgtaatcccagcactctgggaggctgaggtgggtggatcacctgaggtcaggagttcaagaccagcctggtgaacatggcgaaaccccgtctctaataaaaatacaaaaattagccgggcatggtggtgcatgcctgtaatcccagctactcgggaggctgaggcaggagaactgcttgaacccaggaggcagaggttgcagtgatccaagatcatgccactgcactccagcctgggcaacaagagcaaaactccgtctcaaaataaaaagaaaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctgggccaaccagacccacaattaactgagcctcagtgaaagcgtccagtgcatcttgacctgagacagcaaggaattgcatttggggttattccaacgatgatggcagggaactggtggtatttagtgctgaggggcagtgatacagaaagatttgccctgtgggacagggtcctgcgcgagtcccatccccaaaagccagcagctcctgccatgaggaagacggggtttctgagcaggcttatgcctgcaggttcctgtggagccaccggctgtgacgggacacctctgggtctcagcattgccctggggaggctgggacatttagggacatggtagggttttaacatttgtttcccaaatgtcaaatcccgggcacaggggcaagaccctgtcccgaattcccaccccagtgaatggtgtcgctgccaaagccaacacaagatgacaaaagtggctgggtacggtggctcacgcctataatcccagcactttgggagaccgagacaggtggatcacctgaggtcaggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactg

SEQ ID NO: 2589 - DNA, 1047 bp, Homo sapiens
atggggaccaccgaagccacgctccggatggaaaacgtggacgtgaaggaggaatggcaggacgaagatcctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagaatgtcc

SEQ ID NO: 2590 - DNA, 10603 bp, Homo sapiens
ctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagttttacctcacaaaaactactacaagcaccaagctccctgatggaaaggagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcataggggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 2591 - DNA, 10587 bp, Homo sapiens
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 2592 - DNA, 10636 bp, Homo sapiens
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagttttacctcacaaaaactactacaagcaccaagctccctgatggaaaggagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 2593 - DNA, 3329 bp, Homo sapiens
ggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattgggttttctgaactctggcaggcggttgaagtagtttctcactgtgattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtaggactggattaaatgaccactgaactcactgaatccagatcattcatatcatcaacaaaagctctagggggaggtcacgttgtgaatgcttaaaacatattattttcttcaacaaccatatcgctaaactaatatatccagagattttgcacaattcgtgttgaaccttccaaaacaaaaataaagacctgtccaaaagttttgacaaaaatactgattgctcccaaataaagtgcttctaagctttgtgtagacatagtttaactgatttgtaaaaatagcttaagcatgttgagaatgaagtaaaagttttcccatgtgctgtctaatgtactctgtgtaactctgaagacacatcagcttctaggattgcagcaatctatgaataacattttttctctcatttatgactttccatcagtaaagaagccattgcagaatttaaaattacacaaaggagtcattctctcctgggacataaagagttaaagctctgtcctctaaatagaagcctggccaaagggagaaaacagtgggagtcccttttcccttttaacaagtttgcaatagacacttctttttttcctgtctcaatggatgtgtgcacaccagtggaatcgcacaaacttgtcggtatgagctatataataacaaacacaaataaataaaagggagccttgtgagaataca

SEQ ID NO: 2594 - DNA, 3135 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattgggttttctgaactctggcaggcggttgaagtagtttctcactgtgattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtaggactggattaaatgaccactgaactcactgaatccagatcattcatatcatcaacaaaagctctagggggaggtcacgttgtgaatgcttaaaacatattattttcttcaacaaccatatcgctaaactaatatatccagagattttgcacaattcgtgttgaaccttccaaaacaaaaataaagacctgtccaaaagttttgacaaaaatactgattgctcccaaataaagtgcttctaagctttgtgtagacatagtttaactgatttgtaaaaatagcttaagcatgttgagaatgaagtaaaagttttcccatgtgctgtctaatgtactctgtgtaactctgaagacacatcagcttctaggattgcagcaatctatgaataacattttttctctcatttatgactttccatcagtaaagaagccattgcagaatttaaaattacacaaaggagtcattctctcctgggacataaagagttaaagctctgtcctctaaatagaagcctggccaaagggagaaaacagtgggagtcccttttcccttttaacaagtttgcaatagacacttctttttttcctgtctcaatggatgtgtgcacaccagtggaatcgcacaaacttgtcggtatgagctatataataacaaacacaaataaataaaagggagccttgtgagaat

SEQ ID NO: 2595 - DNA, 1939 bp, Homo sapiens
agagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgtaatgtatccatatatgagaatagttggaaaatttaggcttctcgacgtcctgtgcgaaatgactgtgaatactgagctgctcggctatctgcaggttttccctggcttgctggaaagagttatagatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctgttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttg

SEQ ID NO: 2596 - DNA, 7876 bp, Homo sapiens
ggggggcgctgggtgtggggcggctccggggccggggatggcggcggccgcggttgcggcggctccgggacgagtgagtggatcctgggaagcgctgtgaaatgggctggctcccgagccagccgggaggacacttactacagctgctcagaagcaccactggaaactcagatgtgggcgccccagccagaagcagagaggggtacagggaagctacagagaagccccttctgatgccccagggagcaagtcgactccttccaggctccaggaacaccacaaagcaatatgaaacctgttcatgaaaggagtcaggaatgccttccaccaaagaaacgagacctccccgtgaccagcgaggatatggggagaactaccagctgctccactaaccacacaccctccagtgatgcttctgaatggtcccgaggggttgtggtggctgggcagagccaggcaggagccagagtcagcctggggggtgatggagctgaggccatcaccggtctgacagtggaccagtatggcatgctgtataaggtggctgtgccgcctgccaccttttcaccaactggactcccatctgtggtgaatatgagtcccttgcccccaacgtttaatgtagcgtcttcactaattcaacatccaggcatccactatcctccactccactatgctcagctcccatccacctcgctgcagttcattgggtctccttatagccttccctatgctgtgccacctaatttcctaccgagtcccctcctatctccttctgccaaccttgccacctctcaccttccacactttgtgccatatgcctcacttctggctgaaggagccactcctcccccacaggctccctccccggcccactcatttaacaaagctccctctgccacctccccatctgggcaattgccacatcattcaagtactcagccgctggaccttgctccaggtcggatgcccatttattatcagatgtccaggctacctgctgggtatactttgcatgaaacccctccagcaggtgccagcccagttcttacccctcaggagagccagtctgctctggaagcagctgctgcaaatggaggacagagaccacgagagcgaaatttagtaagacgggaaagtgaagcccttgactcccccaacagcaagggtgaaggccagggactggtgccagtggtagaatgtgtggtggatggacagttgttttcaggttctcagactccacgggtagaggtagcagcaccagcacaccgggggaccccggacactgaccttgaggtccagcgggtggttggcgctttagcttctcaggactatcgtgtggtggcagctcagaggaaggaggaacccagccccctcaacctatcccatcatacccccgaccatcagggtgaggggcgagggtcagccaggaaccctgcagagctggcagagaaaagtcaggcccgtgggttctaccctcagtcccatcaggaaccagtaaaacatagacctttacccaaagcaatggttgtagccaatggcaacctggtgcccactggaactgactcaggcctgctgcctgtgggctcggagatcctggtagcatcaagtctggacgtgcaggccagagccaccttcccagacaaggagccaacgccgccccccattacctcctctcacttgccttcccatttcatgaaaggcgccatcatccagctggctacgggagagctgaagcgggtggaggacctccagacccaggattttgtgcgcagtgccgaagtgagcggggggctgaagattgactctagcacggtcgtggacattcaggagagccaatggcctggatttgtcatgctgcattttgtggttggtgagcagcagagcaaagtgagcatcgaagtgccccccgagcaccccttctttgtatatggccagggttggtcctcttgcagccctgggcggacgacacaactcttctctctgccctgccatcggctacaggtgggagatgtctgcatctctatcagtttacagagcttgaacagtaactcagtttctcaggccagctgtgctcccccaagccagctgggtcccccccgagaaaggcctgagaggacggtcttgggatccagagagctatgtgacagtgaggggaagagccagccggcaggagagggctcccgtgtggtagagccttcccagcctgagtccggtgctcaggcctgctggccagccccgagcttccaaagatacagcatgcaaggggaggaggcacgggctgcgctgctccgtccctctttcattccacaggaggtaaagctgtccattgaagggcgttccaatgcgggaaaatgaacctcttccccagaccaggactggggctttaccccagagcctcgcctcgccgccgtgagcaggcagaggatttgcacacgccgagcagggaatggctttcttggcagtgagatttgggggaaaggggaggcatgaagtcagcctcccaaggcaggatctgttgttcattaccccatggcatcctttcaggacaaccccagagggtgttgtgatggggagcagcaggcctggggcaaggaaggaagggggtgcacacaggagaagaaacattccaaaatcagggcctccctgttctttcctccccatccctagctcctgcaagagaaagtccaggctttgggagcagatggcagagggagggagtaaagaaagagccaaaaatgatgatccacagcttatagtagcagttaaactgtcagaagttttttttcttttttgtggtagaagggcaggaggccccaaggttggaaataagagggttcccacccagaacccttcttgtgagagatgcgcactttaaagggtgattttgttccagatgtctatggctgggtgtgtgggggaggagcactctcatctgcaggactctgcttgatcctctgcttcatagcccttccccatctctcctcaccattctgcctacaaggcttctagcagcacgggggcccggagggagagccccttcagggttcagagtgaagtactaccttgccagggactcagtcaggggactttgggagaaagacttgatagccaggctgactgggttctaggcaggccctctggaaaggtagctcacctaacaaagctcctccatctcagcatgccagacccactttgaaatctcacagaatcttgctggtaatggtgactttagaactagtagaccctttttcccaggcactgaccccccacctttgtctgtgttgtgcccaagtgcctgcgccacccccaccctcctgctgcgctgaccgctgcatggtgtcgtgacctgggcctcatttgtagctgcactgcctttccttgtctgcaaagttggttttgtccactctgaccaagacctctagtttttggtgggtagggggtctctctggtttccccttcagctataatctctatttttaaaatctcaaaatcatgtcccctccacttccactgccaaacagcttggtgaagaaacaagaagggaactatgccctgggccagggcgaatgcgtggctgggcagtgcccatcatggcattttcacatgtcccatatgcccctcctgtcttattccactgcttctcccagcattctggtgcctccaagccatcccctcccaccaccagctctaagattctaggatagtcttgataacatttcagtacctgaatagatgtcattttgtgttggtatattcctctgcaaaaagtattttcaatcttggttgcattggcaccccccctaccccccaccaatgtcttaatcccacattttcttcacaacttttagcatcagctcagaccgtggggttccactgggtattgggaattaggctcccccactagctttcaggtgggtaagtttttttgtttgttttttgggggtctttagactcttgaaggcaactcagggtattgtccacgcagctctctggttagacttctcccaggctatgatcctggcatgtcctttataaggtatacttggattggccgagacctggcctggcatcaggagtccaaacctctgaggtctgatctctgctctgtcaaggactttcggcaagtctcgtgacctctggctctttcacttcctccccacctgccaaatggggataaataatcttacctacctcctggggggaggggaagttctgagaatggagtcattcttagtgttcaggtgctaaaggttgttctcctgggggaacagagtgactgaaactggcttgtttgctacaagccctaccctccactctttcattccttgaaagcagtttgcctggtcagtcagcttttgggggtccatcaaaggaggttgctgacctgaccgtgagtgcttcagtatctggtttgtgtcagaaccagacgccaactttgtactgcatttgggatcatatctttccccttctctgtcccccattctctgaatgctgctttctctggcttgtttcctacagtgggggcctgtggggttgagtcttgaggaatcccctcaaatgagaaggccttgggagaaggcctcatctctggctgtttcatgagcaactcattcctagagttcattgtttgcatgggtttctcacaagcgtccttcctcataggaaggctcatcaactgaatttagtgacatgtacacagtagatgctcaagcagtgtctgcaaggacacaagctgagctttctccttatggggcaaacctatgtctaaccagatacagaccaattagtttagatcaaatcaccttccacttgggctacttgtgactttccaacctggtaacttccactgaattctggaaagagaaattcttgaggaccctggcaagttgggccctgacctttctgttgctgtctcttgctggtgaagcaataccagcagttcctgtaataccacaatatcgttccatgcatatataacatattaatacttgattttgctgagctgcaaaggtatctgtcataaaatatggtccccaggaaaagaatctctgtgctctaaatctcggtcagagctgtggcctcccccttgcctttaacctctagtttagtcttttcctccaggcatgaaaaatatgactaacctgtggtgtgtccattcttccttataggaatttcctgagtttgcaggagacatgagagcagtttttagcgagtattttagtgggaagttgccaactttttaagaatgagcagttgacaagggccagagcctgtcccttgtcagcagtaggacatttccagctcttaggaatagaaaggaggactgctgactgtctggcgctgtataaaaatgtgtataccaatttgggaataggggaacccagtcatggatggataataagccaagtcttgaatcattcctatcaagattagtatacatgaggaagaggtggcatggggggaaggggctctgggagttcagagctgagtacttgtacctgagggagggcccccagccaatctgggctggtccttctatattcttggtcccagttggtcataacaccaagggctttgccctgcgctgctttgccactgctgctgtccgctcactgtcctgcctgctgtcctctacagctccctatccttccatgtctttggccatgtagattaagtgtaggcgtccggttcattcttacctgtgttaggccatgttattttatagcgaagtcatgttcgatagggatggtatgaaatgctgctggtgggctggtaaatccaaagggataaggcttcagtgctgttgggagccctctggctccaaatgtctgactatcttgagggagaaacaagcaggtttctactagtggtgtcttctgttgtattaacttctttcctttgtggtatcttgtatcctgttttaaaaactaaatgaagggaaccacattagggcccatgccagcatcccagtgaagttcgtccagctccagttaggtggattctggagttcggagagggtttaaagtttggctgaaatagcacctcaagtggggtttagttttatttttacctgcgggcatcatgggcgatttagggggaagcacaggatggtggtgtggtttaaacctgcagcaagcaggcatgttgaagagttgagtgatcacgctggagatgaagggttggacatggattgactgggaaaaggcctgggtccattggagtaaagataacctagtcgattgaattggccatgggaagttaggtcacagtcttataaacaaagtaaataggacagagactaagttttagggagacatcttggcctcctaggctaagtttactaaaccacactgaagctatagtaccttccagatgggcaaaagtgtacactacagttgaggagctgaaccttattaggttggatgtcgatcaggaacctgtttgccctttgctgggaagccttcactctccagctttcctggggtagggaaggtctcccacattatgcaataataaaataagcatctgggtctttgcagctgtcagttgctctttcaactctaggatccatctttggaccagaagcctggtctgtgcctaggatgacactggccccagagatgctagagtcgactgcactctctccttagctgcagaccatgcacagtgcctggggcggaaggaggagaggtgttgcggtttgccctgctgcctccccagcaggaacaatagtcataaatgcacttttcacactaaaggtttctttattagttctccagttaaacctagatccctccctggtagattgcgaactcaaagttttgtgatcccaaagccattccactgcaaatgcccagcagtgaagatggcctcaaattgggttcttgcctgcagtgtgtgtggcagcagcccatgtgcctttacctgttgtcaaacttgcaagcatttatttgtctttatgactgtcatggggactgaggttcttcagagaaagagtgtgagctgatgacacagtggttttacacccaccccctgggcagggagtttgcacgtagttgtgagctgtgagtggttagtgcattgctggtattgctgaaggcagggttgatccctcacttgactgatacttgcattcaagagaatctagattgtgttgggggagggactgactgtactcatggctaacttaaagtattaaaataaggctgtcccctacaaccttcttagtcacacaggatccctgtagccaaaacagtatatgatccagctgcagagagcagactgctctcagcttgcacagcaccttaggcgagggaagaatatacggatagggaatggggtggagaaaggatgggaatgttgtcatccaggtggctttagggtcctaaggagtggagaaggatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgtatatttgtacttttgtgagatcctttttgctgttttaccattttaagtctctgtacttggctacacacagattgtatttttattgttaatgctcttcttatggatacctgcatttaacttgtggactatgtaaacacaatatctatcaatatctatatatctatatatctatctatataaactactagcttttc

SEQ ID NO: 2597 - DNA, 4702 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactga

SEQ ID NO: 2598 - DNA, 4587 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaataccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataat

SEQ ID NO: 2599 - DNA, 3786 bp, Homo sapiens
ccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaact

SEQ ID NO: 2600 - DNA, 4367 bp, Homo sapiens
ccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 2601 - DNA, 3856 bp, Homo sapiens
ggcgacgcgcacgcgcgccagcccggctcgcgccctctcgctttcctccagccgcgagaccccctccccttccgcctcgcggcgcttcctcgcgccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 2602 - DNA, 1370 bp, Homo sapiens
ccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcctcacagagggcagggccagggtccagcaggggtggggggttcctgctctgcccctgcccgtccccacccagtcttgccctcccatcctctcatctattcccccgctggagacggaagatcttttattttctattatttataa

SEQ ID NO: 2603 - DNA, 3737 bp, Homo sapiens
ccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactt

SEQ ID NO: 2604 - DNA, 3981 bp, Homo sapiens
ccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattctatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 2605 - DNA, 7224 bp, Homo sapiens
aaagggtgaaagagaaacttggcgacctcccggaggagttcgcgaagcgaccaggagcgtgttgccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtggttcactgccaagccaatagttctagaacctgcctcctttacagttttaagggatgcctctgttctgtgaaaagtctttgtcccttttagtgtctcgggagtggattcatacagatgaagtgggcattgcttcttcctggttgcctggtttcccgatagactacatgtaactaagtgacacactgcttttcttttgttagtattttatgtgtgggagtatgtgactgcgtgtgtgtgtgcctgtgcgtgtgtgtgtatactcagcacatgtatgttactatgtgatgtggtttaaaactaatggaaaaaactgaaagtgcctgaaactagttttaagcttagacagaatctctttaaaaagacttgaatgttcagttgaacttttggagtttgctttttccacctaaatattgtttctaaaattttaggggcggagttgaaaaccaccaatgctggtaattttataaggtattttaaaattaagacctcttggttcatagtaattcaattggtgatggattgcctggtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgaacaaatgtcaagggatagaaaattactttggatatttaaaagagaagaaatatatagtctatttgttttgtaacaagtttctgtaaataaaataatttatactatttataagaaaa

SEQ ID NO: 2606 - DNA, 7285 bp, Homo sapiens
gaaaaagggtgaaagagaaacttggcgacctcccggaggagttcgcgaagcgaccaggagcgtgttgccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcaggatatctcctcaccttgcttacgaacaggaatttcagcaacatcaccccagagccctgacttaaaatccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtggttcactgccaagccaatagttctagaacctgcctcctttacagttttaagggatgcctctgttctgtgaaaagtctttgtcccttttagtgtctcgggagtggattcatacagatgaagtgggcattgcttcttcctggttgcctggtttcccgatagactacatgtaactaagtgacacactgcttttcttttgttagtattttatgtgtgggagtatgtgactgcgtgtgtgtgtgcctgtgcgtgtgtgtgtatactcagcacatgtatgttactatgtgatgtggtttaaaactaatggaaaaaactgaaagtgcctgaaactagttttaagcttagacagaatctctttaaaaagacttgaatgttcagttgaacttttggagtttgctttttccacctaaatattgtttctaaaattttaggggcggagttgaaaaccaccaatgctggtaattttataaggtattttaaaattaagacctcttggttcatagtaattcaattggtgatggattgcctggtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgaacaaatgtcaagggatagaaaattactttggatatttaaaagagaagaaatatatagtctatttgttttgtaacaagtttctgtaaataaaataatttatactattt

SEQ ID NO: 2607 - DNA, 728 bp, Homo sapiens
gaaaaagggtgaaagagaaacttggcgacctcccggaggagttcgcgaagcgaccaggagcgtgttgccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggctggagcgcagtggcacaatcgtggcttactgcagcgttgacctcctggcctcaagcagtcctcccactgcagcttctcaagaagccggggatacagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgc

SEQ ID NO: 2608 - DNA, 3683 bp, Homo sapiens
ctgccctggggccggccggccggctcctccataggtggctgcatttccgacttcgccctggctccagtccgggggcttgacgtgcaaacttcgccggagcgagctgagagggagggaccggcaagtgggaggaggcggcgggaggcgtctccgcttaagggagccggccgggtgccgccgctcggacggacgcgcggacggaaggaaggagcggggcagccgggccgggcccggggatgcaagcggccgaagggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagca

SEQ ID NO: 2609 - DNA, 6732 bp, Homo sapiens
atgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcaggatatctcctcaccttgcttacgaacaggaatttcagcaacatcaccccagagccctgacttaaaatccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtggttcactgccaagccaatagttctagaacctgcctcctttacagttttaagggatgcctctgttctgtgaaaagtctttgtcccttttagtgtctcgggagtggattcatacagatgaagtgggcattgcttcttcctggttgcctggtttcccgatagactacatgtaactaagtgacacactgcttttcttttgttagtattttatgtgtgggagtatgtgactgcgtgtgtgtgtgcctgtgcgtgtgtgtgtatactcagcacatgtatgttactatgtgatgtggtttaaaactaatggaaaaaactgaaagtgcctgaaactagttttaagcttagacagaatctctttaaaaagacttgaatgttcagttgaacttttggagtttgctttttccacctaaatattgtttctaaaattttaggggcggagttgaaaaccaccaatgctggtaattttataaggtattttaaaattaagacctcttggttcatagtaattcaattggtgatggattgcctggtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgaacaaatgtcaagggatagaaaattactttggatatttaaaagagaagaaatatatagtctatttgttttgtaacaagtttctgtaaataaaataatttatactattt

SEQ ID NO: 2610 - DNA, 2792 bp, Homo sapiens
atgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacggggacagaattggacgaaagtttcaaggagtttggaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcaggtaggaaatggactgtgagccccatgggaatgcccatttcttctcccttaagatcttttgtcagctcagaaatgtgtttggttgggttggttggttggtttgtaaacagatattcagcttcatggtgtcttctt

SEQ ID NO: 2611 - DNA, 2741 bp, Homo sapiens
gttttctgttgatctgccaggacctttgtaattcaagtgctttttacagtagtagcaaatgttacataagcccaaacatggagcatatttggagttggtgggcagacccaaatcatgatgcaagcctgcagtagcaagtgtgcaatgaagcacaaccaaattctgtgaatggaaggtagcaagacgcctctccaaagcagcccttctgcgcaggagctgaaagctccactggaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagcca

SEQ ID NO: 2612 - DNA, 3033 bp, Homo sapiens
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagaatgtcaactatatcacatcatggctgagcattgtagggccagttgttgggctgaatctacctctgagttatgccaaagcaacgtctcaggatgaacgaaatgtcccttaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactggtgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcggggaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctgaaactggtgttataaacatgacctatcttaagtgattttcccacaatcaaactcaggaacaatagattatttctgttttactccaaaagagagagagagagtgagtgtgagtgtgtgtgtgtgtgtgtgtgtatgtgtgggtgtttgtgtagatagttgtaaaacaaagaaaaaacacaatattttactgtgagataatatgttttaccagcaaagtgtggcatagtaattagaagttttctaaaaagctataggagatatttaaacattaaaatttctttttgacctatagtaataaaacaatggtcattttacccctctgcttctcaaccccacagctgctctgctgtactctttgagggctcttgagcgagtcttcatgtccctgagacttattttcctcatctttaatttgaaactaacaagctacctcatagggttgctgtgagaaccacatgagatcattaatgcatgataagatattgtaaagtattatacgaatattcattaaatgctcacctttcttgtatataattggtattcactaaggctgtaaataagtttcatagccagttaagtattaagataaacctaacctggaacaattttttttttggttgcttgttttgttttttgctttcatttgctaggagctgaaacgaagattaaaatgtcattggctttttagagagtctagattagtgtgtctttgaatgagggatatacttaaaatcacctgaggatcgtttacagctacagatgctggggccacctgacacagtctctctgggggtgattctgctctggagaacctctggtctggatatacctttattgtgacattgatttgtattgttttgctctactgacaggccttttccaatccatacaagctgaacttgcttcctaatgtttgtctaggccttacatggatagtaaggaagcttaggagacatgtacacaaggcagcccacttgtaggaaactgcttcaggtgaggacatcattcaccagtggatcaccgagcaccgtgacagcaccctcagtccacgtctgcagattaagagctgaactctcacagagaaagtggaagtagagaaagggttaattcaaactgctagaaaagctaaaagtaaattttaaaatgctgagctgcccatattcatgctaggatgagagccggcttaaatgcttgctgggcattttggtatttaccacttagcatgttttcaacttctgtgagggattttccccccaatctccctaatgtaaacacagatttctcagcaagtcatttctcaagccatgtcatttctagtgtaaaataaattataataatgtgtcatctgaa

SEQ ID NO: 2613 - DNA, 1438 bp, Homo sapiens
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggtgaagtcttgctctgtcacccaggctggagtgcagttgcgtgatctcagctcactgcaacctccgccttctgggttcaagcagttctcctgcctcagccttccgagtaactgggactacaggggttcaccactacacctggctaattttttgtatttttagtagagataaggtttcaccatgttggtcaggctggtcttgaactcctgacatcaagtaatccatccgcctcagcctcccaaagtgctgagattacaggcatgagccactgtgcctggccctgagcttaaaataaaagttaaattaaaaaaaaaataatgttgatgttttcatttttgcaatcaatagcttagttagactcaaattgcaaactgtcattgcctgtagtaggcagtggcatagaactcaattcagctcttttaacctgagttttaagctgctttcagattgccccacacatacatggttcaggagtcagccagagacttgggctgagtttaaacatagaatctggggttgtcctcttctggctgtcttctttcttgggcatctgcatcattctctagcacctatggtttttccaggctctttcccccagtttcctccagtcagaaagatggcaagagtttttgctgcctgccctcccccagtccttgtgccaacaccaccaccattgcagctgcctccagggaaaaactgcaaaaaccaaatcacttgctccaggtgttgactcctcttcaaaatctatttttgttaaatctccaaagcctcaaataggttttcttcctagaatttatatctgttatttgtagcaggattggtctgtaaggcactcagtcttctacatcatgggtcagcagattacagcccttgggttaaatccagccacctgcttgttttattaataaagttttgttggaactaaacc

SEQ ID NO: 2614 - DNA, 2418 bp, Homo sapiens
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggtagagacggggtttcaccgtgttagccaagatggtctcgatctcctgacctcgtgatccgcccgcctcggcctcccaaagtgctgggattacaggcgtgagccactgcgcccggcctgttgtacagttattaaagttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagaatgtcaactatatcacatcatggctgagcattgtagggccagttgttgggctgaatctacctctgagttatgccaaagcaacgtctcaggatgaacgaaatgtcccttaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactggtgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcggggaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctgaaactggtgttataaacatgacctatcttaagtgattttcccacaatcaaactcaggaacaatagattatttctgttttactccaaaagagagagagagagtgagtgtgagtgtgtgtgtgtgtgtgtgtgtatgtgtgggtgtttgtgtagatagttgtaaaacaaagaaaaaacacaatattttactgtgagataatatgttttaccagcaaagtgtggcatagtaattagaagttttctaaaaagctataggagatatttaaacattaaaatttctttttgacctatagtaataaaacaatggtcattttacccctctgcttctcaaccccacagctgctctgctgtactctttgagggctcttgagcgagtcttcatgtccctgagacttattttcctcatctttaatttgaaactaacaagctacctcatagggttgctgtgagaaccacatgagatcattaatgcatgataagatattgtaaagtattatacgaatattcattaaatgctcacctttcttgtatataattggtattcactaaggctgtaaataagtttcatagccagttaagtattaagataaacctaacctgg

SEQ ID NO: 2615 - DNA, 2366 bp, Homo sapiens
agccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttc

SEQ ID NO: 2616 - DNA, 2915 bp, Homo sapiens
actagcgagcgccctgcgtaggcaccggctcctgagcccgtgcttcgggtgagggggcgggtcttccggccctctcgaaaatcatttccggcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcc

SEQ ID NO: 2617 - DNA, 2767 bp, Homo sapiens
aagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 2618 - DNA, 3405 bp, Homo sapiens
actagcgagcgccctgcgtaggcaccggctcctgagcccgtgcttcgggtgagggggcgggtcttccggccctctcgaaaatcatttccggcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 2619 - DNA, 3313 bp, Homo sapiens
gtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttggtctgtccgagtctccccttttgggacatcattcttcttctgatgctgccaggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 2620 - DNA, 3213 bp, Homo sapiens
gtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 2621 - DNA, 3130 bp, Homo sapiens
gtgcttattggccagcctggctgcgggtgacagtgagtggcagacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctg

SEQ ID NO: 2622 - DNA, 3799 bp, Homo sapiens
agtcccgtccctgaagccgagaattggccgttgtgtctccgccccccgtgcttattggccagcctggctgcgggtgacagtgagtggcagacacccggcctagcgccgcgggtcgcgccgagccgagccgagccgagcggagccggcggagcctctggaatcacccgggtcgctgttcctgaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 2623 - DNA, 2512 bp, Homo sapiens
agacacccggcctagcgccgcgggtcgcgccgagccgagccgagccgagcggagccggcggagcctctggaatcacccgggtcgctgttcctgagcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatag

SEQ ID NO: 2624 - DNA, 4025 bp, Homo sapiens
ggggcgcgcgcgggcgccggggccgcgcgcgaggttgtccgctgttgggagctgccagcccttggcctggggccgggcgaccctggggcgaggtggactccggtccacggtcgccgcggctgggtgtggggaggcaagccaacccacccgggctatcagctgtaaggctgactcgatccctgcaacatccgcaggaacccctgagcccaggcccagccggccggggctccacgggccctggtccacactgaccctgtgagtggtgacttccctgaggggcagggctctcactagcccagggaatcccaccggggccaggctgggccaagatccacggcccccaggggctgcacggacagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgacca

SEQ ID NO: 2625 - DNA, 700 bp, Homo sapiens
ctagcgccgcgggtcgcgccgagccgagccgagccgagcggagccggcggagcctctggaatcacccgggtcgctgttcctgagcagctgcagagcatcgagggctggagaggagcacatactgtccatggagctgggtctcttcttcctccttattggcaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcat

SEQ ID NO: 2626 - DNA, 796 bp, Homo sapiens
gcgcgaggttgtccgctgttgggagctgccagcccttggcctggggccgggcgaccctggggcgaggtggactccggtccacggtcgccgcggctgggtgtggggaggcaagccaacccacccgggctatcagctgtaaggctgactcgatccctgcaacatccgcaggaacccctgagcccaggcccagccggccggggctccacgggccctggtccacactgaccctgtgagtggtgacttccctgaggggcagggctctcactagcccagggaatcccaccggggccaggctgggccaagatccacggcccccaggggctgcacggacaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatcca

SEQ ID NO: 2627 - DNA, 568 bp, Homo sapiens
cttgagaccctggagttggaagagtggcccggtttagcacagccagaggaagtgctcgtagtcctgggctggaagggtgcttcttccccactgcagccttcctgccccatgcttggcctcctcttggtggggtgtggatggctgggagggttgggttcctttttatccccactgcccactctctggggcctgacatcttctcctccagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctattt

SEQ ID NO: 2628 - DNA, 893 bp, Homo sapiens
ctagcgccgcgggtcgcgccgagccgagccgagccgagcggagccggcggagcctctggaatcacccgggtcgctgttcctgaggaacccctgagcccaggcccagccggccggggctccacgggccctggtccacactgaccctgtgagtggtgacttccctgaggggcagggctctcactagcccagggaatcccaccggggccaggctgggccaagatccacggcccccaggggctgcacggacagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgt

SEQ ID NO: 2629 - DNA, 589 bp, Homo sapiens
agtgagtggcagacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtagggccatgtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcc

SEQ ID NO: 2630 - DNA, 685 bp, Homo sapiens
gttgggagctgccagcccttggcctggggccgggcgaccctggggcgaggtggactccggtccacggtcgccgcggctgggtgtggggaggcaagccaacccacccgggctatcagctgtaaggctgactcgatccctgcaacatccgcaggaacccctgagcccaggcccagccggccggggctccacgggccctggtccacactgaccctgtgagtggtgacttccctgaggggcagggctctcactagcccagggaatcccaccggggccaggctgggccaagatccacggcccccaggggctgcacggacagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatg

SEQ ID NO: 2631 - DNA, 699 bp, Homo sapiens
agtgagtggcagacacccggcctagcgccgcgggtcgcgccgagccgagccgagccgagcggagccggcggagcctctggaatcacccgggtcgctgttcctgagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatg

SEQ ID NO: 2632 - DNA, 2628 bp, Homo sapiens
agggagggtgtgacgctggtatctgtgtgaactcgggcttgtgatgctgagcttggttcatctgctttctcctcccttttcctccccactccttcccaccagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgagcgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattccacgtttggatatgctcatttaatttctacagaaaaaattttaaattatttcacattagccatttgttaaaacacagcatcataactcagcaggctggatttaatctgtatcatcttatatatatcacaatcttatttttaagcacattttagagttccttagttgctttatcaaaaaccagatattgcttttacatggtttaatagaatataaacctcttgataaaaaatgcacaaaaaatcactttgtatatgtgagtttcactgcattgtatattttttcatttggtacacaaagaatgtattcttcataggtttattcttttaatatgtgaactattattaaagtttactctggttcctaagattaaaaacaaatgcttactgaatttg

SEQ ID NO: 2633 - DNA, 2643 bp, Homo sapiens
agggagggtgtgacgctggtatctgtgtgaactcgggcttgtgatgctgagcttggttcatctgctttctcctcccttttcctccccactccttcccaccagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgagcgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggccccagtcatcaagctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattccacgtttggatatgctcatttaatttctacagaaaaaattttaaattatttcacattagccatttgttaaaacacagcatcataactcagcaggctggatttaatctgtatcatcttatatatatcacaatcttatttttaagcacattttagagttccttagttgctttatcaaaaaccagatattgcttttacatggtttaatagaatataaacctcttgataaaaaatgcacaaaaaatcactttgtatatgtgagtttcactgcattgtatattttttcatttggtacacaaagaatgtattcttcataggtttattcttttaatatgtgaactattattaaagtttactctggttcctaagattaaaaacaaatgcttactgaatttg

SEQ ID NO: 2634 - DNA, 2647 bp, Homo sapiens
agggagggtgtgacgctggtatctgtgtgaactcgggcttgtgatgctgagcttggttcatctgctttctcctcccttttcctccccactccttcccaccagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgagcgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggaagtacaaatgaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattccacgtttggatatgctcatttaatttctacagaaaaaattttaaattatttcacattagccatttgttaaaacacagcatcataactcagcaggctggatttaatctgtatcatcttatatatatcacaatcttatttttaagcacattttagagttccttagttgctttatcaaaaaccagatattgcttttacatggtttaatagaatataaacctcttgataaaaaatgcacaaaaaatcactttgtatatgtgagtttcactgcattgtatattttttcatttggtacacaaagaatgtattcttcataggtttattcttttaatatgtgaactattattaaagtttactctggttcctaagattaaaaacaaatgcttactgaatttgaaaa

SEQ ID NO: 2635 - DNA, 2853 bp, Homo sapiens
agtcccggcacaccctactgcaccttcctgttttgcaaaccgatcccggtggtaccagtttgaggctgcactgcacacctgcacaacctgccttctacttagttcttctgagacatttctgaaagtctgaattcctaggactgctcaatgacctttgtccctgttgggcacacgcagtgtctcatcgctggtattgcacctttaatgagaccaggagttccgcaaaagtaaaacaaaggggtcacagactggttctggttctaccacttcctcagtatgtgctctgggacaaaacagcatatttggcaacatctcggtgtccttatctgcagcttgaagaggcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgagcgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattccacgtttggatatgctcatttaatttctacagaaaaaattttaaattatttcacattagccatttgttaaaacacagcatcataactcagcaggctggatttaatctgtatcatcttatatatatcacaatcttatttttaagcacattttagagttccttagttgctttatcaaaaaccagatattgcttttacatggtttaatagaatataaacctcttgataaaaaatgcacaaaaaatcactttgtatatgtgagtttcactgcattgtatattttttcatttggtacacaaagaatgtattcttcataggtttattcttttaatatgtgaactattattaaagtttactctggttcctaagattaaaaacaaa

SEQ ID NO: 2636 - DNA, 527 bp, Homo sapiens
atctttgcaaatctagtgggaaattttacccagtggatattgagttacagatcgtaatgaatctacagctttcatttatcttgatcttcttgatataaattttgctattctaattttaagacaaactactcagtatacatatacaaaaatgcatgataccctctttactaacatgaccttgcttttaaaatggaaaaaaaaatgggtgcctcgtagataaatgcacattattttagctactttggctatataaatgttgccagcttgtttgtactaatgtataaccgtgcttgaaacagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaa

SEQ ID NO: 2637 - DNA, 620 bp, Homo sapiens
agaagactacaagtatagatttgggaatcatcagcatggaggtcctgtctgaagccatcatagtaaattacattgagagagtgtagcgtgaggagttgcttaccatgaggaattagcagagatcatggatctggtaattaagaggctggcagtgatctcctaagaaccgatcagtacagagtcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggt

SEQ ID NO: 2638 - DNA, 2360 bp, Homo sapiens
actgtggtgcgaattgatcgcatgaaatcctgattgaaaattttgatggtacttaagaaaggcataaagttttttcaaaggcttataaatagtaaaagcctacgatttggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacagaggagtcccaggaaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcac

SEQ ID NO: 2639 - DNA, 2868 bp, Homo sapiens
agatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttatttcctgtaatttattttcagtacataattaaaaatttgttgtatatataaaatgaaa

SEQ ID NO: 2640 - DNA, 1883 bp, Homo sapiens
actgtggtgcgaattgatcgcatgaaatcctgattgaaaattttgatggtacttaagaaaggcataaagttttttcaaaggcttataaatagtaaaagcctacgatttggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatt

SEQ ID NO: 2641 - DNA, 2335 bp, Homo sapiens
aaatcggtacaagatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaa

SEQ ID NO: 2642 - DNA, 1700 bp, Homo sapiens
aaatcggtacaagatggcggagggggacgaggcagcgcgagggcagcaaccgcaccaggggctgtggcgccggcgacggaccagcgacccaagcgccgcggttaaccacgtctcgtccacgacctccctaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaat

SEQ ID NO: 2643 - DNA, 1764 bp, Homo sapiens
actgtggtgcgaattgatcgcatgaaatcctgattgaaaattttgatggtacttaagaaaggcataaagttttttcaaaggcttataaatagtaaaagcctacgatttggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacagaggagtcccaggaaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcct

SEQ ID NO: 2644 - DNA, 6938 bp, Homo sapiens
atgaggaccgctggccgggacccagtgagcgcgggactacaattcccaaaggacggtagcactcagcgccccgccaacagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaacatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatggttttgcacacacgatggggaggggatggaggataacctcatgaaaggtgccgttttcgggtgaaacttgacatttcttttatactttactcttttgagaaggattctttttttttttttttttttttttgagttggagtctcgctctgtcaccaggcttgagtgcagtggtgtgatcttggctcactgcaacctctgcctgccgggttcaagcagttctcctgcctcagcctcccaagtagctgggactacaggtgtacgccaccatacccagctaatttttttgtatttttagtagagatggggtttcaccatgttggccaggatggtcttggtctcttgaccttgtgatccgcctgcccgccttggcctcccaaagtgctgggattacaggcgtgagccaccgtgcccggccaagaaggattccttttttaaaagtttacagaacttggagaaacttcagaactaaagactaactgaaaatgatgtcattacactcaaaaaaaatttacaatagggaatcctgttgccacatagtgtggaaaaatcatgtcatatttaaatataccatactctgaaatgtgaggtttttacccagtaggctgacagttttgttgcaacttgctctattttttttttttttttggtccctatagcttctttctagaaaaagaggcaaacgtgccttgaaaagccagagtggctcataataaaaggaatgcgctagatacttcaagaaaaaagctaagtttaaatgaaccatgtgacctctgataagtcacttgaacttgtgccttggtcaggttcactgtaggtttacatatgtatgtatgttttacacaactcttgtaattgtcatttgaggggttttgtttttgagagttctgcataagaacagaactttattaaggattagagggaagatacaaatattactgcgtttaattgatgtctaatttcatgtggcttagcagcaattaataacctgatttaaggtctttattcagaatgttaatttgcattctctgccgtgtctaatgttcttaataatgaagctaaaattaacccattttatttagtgaattatctatttaattttactttggctagtctggtagctttaagatagctttgccttagcaaggatcaaagtcctacccaaatataaaaaatatctagaagtatctaagagttctttttttctatttaccttgattaggagataaaagttttatctgttagttgcttttccttttggaattattgtggattttaaaacttaaaacttgcctgcaagtatttatataaacattcaggtatataagccttaatttctaagataatttaacttttgttatgggagggaggtaagagtgtaaattttatatacatgaaggtaagatctgagtgtaaactttacatacatgaagtatgaatggaaggtagaaaaaaagtcccttttcgcatgtaatctctttatcaaagaattttcttttgacactttaccactgaagtatttttgtaagtcctaaattcgcagcatattgtttcatatttatatgccatcttgcaaatagttcttgctattttattcactgctgttacactttagaaaaattccagcttgtttacttgcatttatcagtgatgccaaccaagctttgactgttaacttgaaagcttgcttctgaaatgttggtgcattttcaggtgacctcttatctctctgaaagttcatacctattagcaggctctgtaaatattgacatacttagcttttaatacattctataagtaaatttatagatttcagaataacttaaaaaatttaatggtaagaaggggtgatgtgtcgaaaactcatactaaagtattaggtcactttaaaaaaagtgataatgtatgatttaatgaaatcttaagattcagttactatttaaattcaccatttctgttttggtcttataaagagaccttggtttaattatccagaggaagtcctcttcaccattttttttttttcttagttctgcttctggaaagtgttttataaagttttctcagtgagggttcttaagagttttctttggcctcttttctctcaacagtaaattgatgattttatatcagctttttcaataaaagatgcattatcattactggctataaatcatcctggggagatttataaccaggttaaaaataatatcttttacttctctcaccttttacttgtggttcagatgctcagactgtgcctgtttgcgtcgtgtctgttgctctgccgctttccatgcaggcatttttaattttacacaatcctaacaatatatggaactcattcctatgaatatataaaaggaggcttccaaaattttctattaaaatatttcaggataaattaagtgttgataatttgaaaaaataatttcaatgagctgcttatagtaaaaatggtagaatcagagttttcattctttgagaaatctttctgtaagattggctcatagataaaatgagacaaactactatgtatgataaaacaccttcagagtcatgccttgttttattttattttattttttgagacagaggtctcgctctgtcgcccaggttggagtgcagtggtgcaatctcgctcactgcaacctccacctcccaggttcaagcgattctcctgtctcagcttcctgagtagctgggactacaggtgtacaccaccacgcctggctaatttttgtttttttactagaggtggggttttgccatgttggccaggctggtctcaaactcctgacctcaggtgatccactccccccagcctcccaaagtgctgggattacaggcatgagccaccccgcccagctgagtcatgccttattttcgtagtataccaagaaatgttctatggaagtttacgttttaacacctcttttatacttggtaaaattgcctgtgtttcgctttattcctttttttttttgagacggactcttgtactgtcacccaggctgaagtgcagtggcgcaatcttggctcactacaacctccgcctcctgggttcaagtgattcttttgcctcagcctcccaagtagcagggattacaggcatgtgccaccacacccggcttatttttgtatttttagtagagacagggcttcgccatgttgaccaggctggtctcaactcctctgggaatccgcctgtcttggccttccagggtgctgggattacaggcgtgagccactggaacctggccttgttttgctttattttttctcttacatgaagtaaagcgctttggtcaaacacacaaaaatactgccttgtactggtggttggtttcattagtggatcacacacagtgttctacttggcttgtaaaatggtgccttggatagggtgagtttggataagtatgtatgtatgtatgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacacc

SEQ ID NO: 2645 - DNA, 7135 bp, Homo sapiens
acacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatggttttgcacacacgatggggaggggatggaggataacctcatgaaaggtgccgttttcgggtgaaacttgacatttcttttatactttactcttttgagaaggattctttttttttttttttttttttttgagttggagtctcgctctgtcaccaggcttgagtgcagtggtgtgatcttggctcactgcaacctctgcctgccgggttcaagcagttctcctgcctcagcctcccaagtagctgggactacaggtgtacgccaccatacccagctaatttttttgtatttttagtagagatggggtttcaccatgttggccaggatggtcttggtctcttgaccttgtgatccgcctgcccgccttggcctcccaaagtgctgggattacaggcgtgagccaccgtgcccggccaagaaggattccttttttaaaagtttacagaacttggagaaacttcagaactaaagactaactgaaaatgatgtcattacactcaaaaaaaatttacaatagggaatcctgttgccacatagtgtggaaaaatcatgtcatatttaaatataccatactctgaaatgtgaggtttttacccagtaggctgacagttttgttgcaacttgctctattttttttttttttttggtccctatagcttctttctagaaaaagaggcaaacgtgccttgaaaagccagagtggctcataataaaaggaatgcgctagatacttcaagaaaaaagctaagtttaaatgaaccatgtgacctctgataagtcacttgaacttgtgccttggtcaggttcactgtaggtttacatatgtatgtatgttttacacaactcttgtaattgtcatttgaggggttttgtttttgagagttctgcataagaacagaactttattaaggattagagggaagatacaaatattactgcgtttaattgatgtctaatttcatgtggcttagcagcaattaataacctgatttaaggtctttattcagaatgttaatttgcattctctgccgtgtctaatgttcttaataatgaagctaaaattaacccattttatttagtgaattatctatttaattttactttggctagtctggtagctttaagatagctttgccttagcaaggatcaaagtcctacccaaatataaaaaatatctagaagtatctaagagttctttttttctatttaccttgattaggagataaaagttttatctgttagttgcttttccttttggaattattgtggattttaaaacttaaaacttgcctgcaagtatttatataaacattcaggtatataagccttaatttctaagataatttaacttttgttatgggagggaggtaagagtgtaaattttatatacatgaaggtaagatctgagtgtaaactttacatacatgaagtatgaatggaaggtagaaaaaaagtcccttttcgcatgtaatctctttatcaaagaattttcttttgacactttaccactgaagtatttttgtaagtcctaaattcgcagcatattgtttcatatttatatgccatcttgcaaatagttcttgctattttattcactgctgttacactttagaaaaattccagcttgtttacttgcatttatcagtgatgccaaccaagctttgactgttaacttgaaagcttgcttctgaaatgttggtgcattttcaggtgacctcttatctctctgaaagttcatacctattagcaggctctgtaaatattgacatacttagcttttaatacattctataagtaaatttatagatttcagaataacttaaaaaatttaatggtaagaaggggtgatgtgtcgaaaactcatactaaagtattaggtcactttaaaaaaagtgataatgtatgatttaatgaaatcttaagattcagttactatttaaattcaccatttctgttttggtcttataaagagaccttggtttaattatccagaggaagtcctcttcaccattttttttttttcttagttctgcttctggaaagtgttttataaagttttctcagtgagggttcttaagagttttctttggcctcttttctctcaacagtaaattgatgattttatatcagctttttcaataaaagatgcattatcattactggctataaatcatcctggggagatttataaccaggttaaaaataatatcttttacttctctcaccttttacttgtggttcagatgctcagactgtgcctgtttgcgtcgtgtctgttgctctgccgctttccatgcaggcatttttaattttacacaatcctaacaatatatggaactcattcctatgaatatataaaaggaggcttccaaaattttctattaaaatatttcaggataaattaagtgttgataatttgaaaaaataatttcaatgagctgcttatagtaaaaatggtagaatcagagttttcattctttgagaaatctttctgtaagattggctcatagataaaatgagacaaactactatgtatgataaaacaccttcagagtcatgccttgttttattttattttattttttgagacagaggtctcgctctgtcgcccaggttggagtgcagtggtgcaatctcgctcactgcaacctccacctcccaggttcaagcgattctcctgtctcagcttcctgagtagctgggactacaggtgtacaccaccacgcctggctaatttttgtttttttactagaggtggggttttgccatgttggccaggctggtctcaaactcctgacctcaggtgatccactccccccagcctcccaaagtgctgggattacaggcatgagccaccccgcccagctgagtcatgccttattttcgtagtataccaagaaatgttctatggaagtttacgttttaacacctcttttatacttggtaaaattgcctgtgtttcgctttattcctttttttttttgagacggactcttgtactgtcacccaggctgaagtgcagtggcgcaatcttggctcactacaacctccgcctcctgggttcaagtgattcttttgcctcagcctcccaagtagcagggattacaggcatgtgccaccacacccggcttatttttgtatttttagtagagacagggcttcgccatgttgaccaggctggtctcaactcctctgggaatccgcctgtcttggccttccagggtgctgggattacaggcgtgagccactggaacctggccttgttttgctttattttttctcttacatgaagtaaagcgctttggtcaaacacacaaaaatactgccttgtactggtggttggtttcattagtggatcacacacagtgttctacttggcttgtaaaatggtgccttggatagggtgagtttggataagtatgtatgtatgtatgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacacca

SEQ ID NO: 2646 - DNA, 1180 bp, Homo sapiens
gcctccgatcctgagcctccgagcctttgcagtgcaatgtcccgcctgctgcatgcagaagagtgggctgaagtgaaggagttgggagaccaccatcgccagccccagccgcatcatctcccgcaaccgccgccgccgccgcagccacctgcaactttgcaggcgagagagcatcccgtctacccgcctgagctgtccctcctggacagcaccgacccacgcgcctggctggctcccactttgcagggcatctgcacggcacgcgccgcccagtatttgctacattccccggagctgggtgcctcagaggccgctgcgccccgggacgaggtggacggccggggggagctggtaaggaggagcagcggcggtgccagcagcagcaagagccccgggccggtgaaagtgcgggaacagctgtgcaagctgaaaggcggggtggtggtagacgagctgggctgcagccgccaacgggccccttccagcaaacaggtgaatggggtgcagaagcagagacggctagcagccaacgccagggagcggcgcaggatgcatgggctgaaccacgccttcgaccagctgcgcaatgttatcccgtcgttcaacaacgacaagaagctgtccaaatatgagaccctgcagatggcccaaatctacatcaacgccttgtccgagctgctacaaacgcccagcggaggggaacagccaccgccgcctccagcctcctgcaaaagcgaccaccaccaccttcgcaccgcggcctcctatgaagggggcgcgggcaacgcgaccgcagctggggctcagcaggcttccggagggagccagcggccgaccccgcccgggagttgccggactcgcttctcagccccagcttctgcgggagggtactcggtgcagctggacgctctgcacttctcgactttcgaggacagcgccctgacagcgatgatggcgcaaaagaatttgtctccttctctccccgggagcatcttgcagccagtgcaggaggaaaacagcaaaacttcgcctcggtcccacagaagcgacggggaattttccccccattcccattacagtgactcggatgaggcaagttaggaaggtgacagaagcctgaaaactgagacagaaacaaaactgccctttcccagtgcgcgggaagccccgcggttaaaga

SEQ ID NO: 2647 - DNA, 1486 bp, Homo sapiens
tctgcactctccgacagctactgcgctaaaagcgctccttccctgagcttcgggaaagagttcatcttcctgcaaaggagtctcaggctttcccagaggacttgaaaggccttcctcgaaccagccacaccaaactctgctgcagaaggtttccttctctttttcaacttcatgttgagaaaatgactttctcttgagcatctcattttcccctaaatttgggcaagtgaagagatatcagcctggtcatccagtagaacagaaggccgagtcccgcactcccccactgtaaactatttgattgcacgtgagttgctttgtttatgacttatttgctcagaagaggcacgttgggaagcggctcgagagaccagcccacgcgcaggtcctgagcgggcgggcgtgcgaggtcggcgcctcgctgcttggggccggggatgaagtcctgcaagcccagcggcccgccggcgggagcgcgcgttgcacccccgtgcgcgggcggcaccgagtgcgcgggcacgtgcgccggggccgggcggctggagagcgcggcgcgcaggcgcctggcggccaacgcgcgcgagcgccgccgcatgcaggggctcaacactgccttcgaccgcttacgcagggtggttccccagtggggccaggataaaaagctgtccaagtacgagaccctgcagatggccctgagctacatcatggctctgacccggatcctggccgaggccgagcgattcggctcggagcgggactgggtgggtctccactgtgagcacttcggccgcgaccactacctcccgttcccgggcgcgaagctgccgggcgagagcgagctgtacagccagagactcttcggcttccagcccgagcccttccagatggccacctagggcgcgcgcctccgcgggggtgggtgtccggcagccgctccgagcctcggccctgccccaagtagcccagaagcctccggcggcccaggattctaaggatgcaatcctcgaggaaaattagtcgattctcagattacctttattcgcatcatcagacctatggacgcaatcatttaattgcctttcttttcccctcctcctttgtattttgtagatttcattaatggatcttgtgaatgggttgattgctgtgaaaataatgccccctttccccttttctgggctactttgagggaaaacaatcttaagaaaaataggattaagctattctgttccagtcctcagagaaataatcactttcttaaactttgtgagtttgtcctgttcgggtgaagttacagtatccattacttgtgtttgctcacaacagagctaccttcctgttgtgtaaatgcgtttttgctttagtgcattgtgtgtgcaagcatgaagtagaaacactttttttttctgggtacagtacatgggtatcggtgctctgtatttttttaaactgtgtacacattattaaaatatacattttataaaat

SEQ ID NO: 2648 - DNA, 1490 bp, Homo sapiens
gggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctgaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaaggcatggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctggaaatgtgctgagccctgttttcacgtatgcctctgcacttctccattcttcctgttttgtctaggttccagagggttaaacagcttatctcccatggcgtgtttggatatctgctgcctgtggtcaggaaccttgcactggggaaacaatcatgtaatccacagacaactctatttgtgttcttcagcctcagcctgaag

SEQ ID NO: 2649 - DNA, 685 bp, Homo sapiens
gcgcaggaggcgcgcggcggcgacggcgcgccgtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctgaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaag

SEQ ID NO: 2650 - DNA, 1310 bp, Homo sapiens
gcggaagatggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctgaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctggaaa

SEQ ID NO: 2651 - DNA, 1789 bp, Homo sapiens
gagcaggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcagaa

SEQ ID NO: 2652 - DNA, 3665 bp, Homo sapiens
gattggcaggtccgcacgccccgcctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttgattttagtttgtgagactttttcattttctttaaaggaactgtctgcacagctgcatgattatggccatgtgaaccagggtttcttaaaagcaggggaagccagatttaatatttagtgaccaaagggatacagaaagcattttgaaaatgtctcaaaatagttgtttcatgacattaattggtgatcaaaattatctgctgtcattgaggcttcgtagtcccttatttttgaattgttgtcatgtcagaataatgacatggttatcagtaacaaatggaaataattattaaatactaaaagtgtagattagaagaagaaatactaaattgtacttgttttgtattgtgcacttaaagcctatagataagaacggttacagaatttaagcacaaagtgtttttcacattgttttgtaaatgaatctttatactctggtagcatttctcataggaaatgaggcaaagctattgaataacttgctcattgagttgatggccaaactgaaattaaaacctaggagttttgactgcaagtctgggacacggtgaccacaacagcagtttcgtggtatttccatagtgattcattcattcattatttagggatgaaaaattgttgcaagttatgtttttatctttctttgaaacttgaaagggcttgggcaagtaaaacaccattgcaaagttaactgcctgattttaactgtttttggagactggagaaataaatttgaactggaaattttgacacaccattctaggatcagttctcacatggtacttaagctcacaatgatttatcagggccactgtcagcaatgccgaggataagccgaaaagaacatctttgttctcggcttctgggaatgacttattgtcccgacacttgacctgtaggttttactgaattctcagcacagagcgagcagggaggcagagccaattgagtggaagagggtgcctctggaaaccagcaggttaggagcccttggagtcctccgcctcggagctgtcatcctgctgttggcaagttagggcacctcagttcagtgctgtggcccccaagattaaggtactaggaagtatcctccattacagggaacaggaataaatgaatcaaaaagctatcgggcctttttgacatgggacgaataaagtaactaataggcaaaggggctaaatgatttccagtcaagtaattagagataagtcatttattaaggaggcagatggggtattattggtatatagatggcatagtagattgctagtatattggtagattattggtatatagatggtatgttaaggaggcagatggggtattactggtatatagatggtatggtagattggtagtatattggcagattattggtatatggtatgttgaggcagatggggtattactggtatatagatggcatagtagattggtagtatattggtagattattggtatagagatggtatattattaaggaggcagatggggtaattagaggtgagacttagggacagggcttgtgatatggaaaggagtgaagtcactgagtaaaagacaagtttactgtcagcagagattcttagaggctcttttctccgtgattaaaaaaaaatcctaaaccagtagtataataaacttcctgcctccagcagtgctgggtagctggcaggatgactgtgcccagtgatgaggtgaccccagtcagaccaacttaatgagtatcccactaattagttggatgatgtttgaagctgtcagttaatctcttagttcacatcgttcttgtgagcaaagtgaaggaatcggataagctctaaatttcggtgatgctgctgctctgagagaccaaggtcgctggagcaaccgtactgctaaaggataagctcttcaaaatcaaaagggacagatttcttaagtttctagtttgttttgtgtttttacatctatttctaccatacgaaagagtaggatggtgagatgcatttctaaatatttttaactactcagtctggatggttaggcttcaagaaaaggaatttatttagtctgaaataaagcaattttgccatttaaaattgaattactttgtagtttaatgattactattgagcaaacaaatctttacagtaatataagtcagcaaaagttttttaaaaggtttaaatccctccttccttacatctatttcattgcttttttaggtttgggaagtaaagcaccagaggaagcatgtgtaaatccttgtataatcgcaggctgtaagtctttagcatctcaggaagttactaacttcaaactaagtatataggtagagtttcttactaaatctagtgcttcttgaaccacaagtagaaagcatttaaaacatgaatgttgttttgtgttttttgaagtttgtaaatagaagacttgttgatgatccgatggcaaggtatttttctcttggtatgtattttagttatttcctcgtgatgcataagtgaaaagagtgaagtttctcagaatgagcaactgtcatccatctacctgctattttattattgctgattacaaaagcaaatcaagagatgagaacccagttgcctgcaagtaaatatttactgcattgagggtcggagcattttcccattaccggttatccatggatcaaatagtgtatctcagtggtaattctagagggccattaaaaccctgatggtgctggaagagatggcagtgctgcatgtcagaaataggtaaactgtaattaagaagttacagatgatttgattacgctcttgtgtatttggtcctgttataatgtgagcagattaaaatcatgtagtgcttaaagctatgtcattatgcaaacatttatggcaacttctgcaaattaatttgaactgtaaaagttccctaatgagacgatgtcctccataactgagaaggacactgcagccattgctgcttaattcctgcatttgaatggttgccgagcgcatggtgtgccctttctcaaagagcagagaggctgcagagcattttggggggtgatgactgaatgaaagtgaaaagaccatttcaaaatagcctttaaaaggaaagccaaggatgattattaatgaattcctgggatctaacagtagtaagaaatttaaactatataaacatatatgttaaaggctagctcttcagaaataaagatcagaagactgcagttcttta

SEQ ID NO: 2653 - DNA, 1878 bp, Homo sapiens
gtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctgtaagttatggatttatttagaagaacagttgcatcttaagtttttggagcaccataaagatcaaaataattttagttttgggttctattcattttttagtcagtgtatttggaagttagttattgggatggtataatttaaagcatgcaggttatagaagtcccctggcctaataaaaagaaagtcttcttgggccctgacaagcagaagtaattggcacattgattttcagttcatttagcaatgcttaggtagagagccatcgtatttgaattaaacctgtttcatttgtctgcacaaatcaaataatttggaggatgaactccccacttgtataattgcaattggagttacataacagtccaagagcatgaaaaactacagttctttacatttttatttcccccacaaccactaatgttctcacaaatcactacttcccgaacataataactacaggcacaggcaagggtcctgctgttgtatcaagcaataaaatctgcaagaccccgcagcgaatactgttttgctaatttattatgctttcagagggtttggttcattttacttttccaaagatgttggtgatgtaaagttaaattctcgtgaaataaaaaggtctgtacagttgataagtgtagacttttgtgttccacattataaaagtggtttgatctctaaagtactttcttgacattgttatttcaaaagtaggcaaggcaaattatcagagagatgtttttcagatttaatttttcttgttttgcttttaaaaagcttcagacccataatagcacagaaatgtgataaatattaatcctttggcagcttatggttatgagcaattttacttattggaactgtctcccctaagcacttttcattttcattttgaattagtaaatattttattacaagtctggagatgcagtgttttgaatttagccctttttctaggggctctctgtctaatctcataattctgagtaatgagacctggttttatgttgggttgttttgttttaacagtaagctaacagaaaatcatttagcctcactcggctcagagctgccagactgcatctaatgctgagattttgcaaagtcctgggggtcaggaagtagtgtccgatccccttaaacaaagcattagcccctctctgttatgcccttcagggttacagaccccacctcattagcacaaggagatgttagtgtcttttaaaggcaaagtagtttctttattctgggagagtgtttacttttactcagcaggaaaatgcctgcttgactaagcctgtgtacttgaaccagcactttttacatctgagccacggcaatgtgaatgatagccacagttatacagttcactataaggaagttatttcttatattcatgttgagtttttaagaaaacacagagaactagccagcaacttgcattttctttttcctcctagaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttga

SEQ ID NO: 2654 - DNA, 697 bp, Homo sapiens
tcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctgtttgggaagtaaagcaccagaggaagcatgtgtaaatccttgtataatcgcaggctgtaagtctttagcatctcaggaagttactaacttcaaactaagtatataggtagagtttcttactaaatctagtgcttcttgaaccacaagtagaaagcatttaaaacatgaatgttgttttgtgttttttgaagtttgtaaatagaagacttgttgatgatccgatggcaaggtatttttctcttggtatgtattttagttatttcctcgtgatgcataagtgaaaagagtgaagtttctcagaatgagcaactgtcatccatctacctgctattttattattgctgattacaaaagcaaatcaagagatgagaacccagttgcctgcaagtaaatatttactgcattgagggtcggagcattttcccattaccggttatccatggatcaaatagtgtatctcagtggtaattctagagggccattaaaaccctgatgg

SEQ ID NO: 2655 - DNA, 1078 bp, Homo sapiens
ctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctgtaaagaaggaaaattcagccagttgattttgtttttagcttactgctgcctttgtccgaagaaactgttcctccattatttgaattactgaagacagcaagatatttgtaaattatcttaaaataaacaacttaaaataaaatcattgtttttctt

SEQ ID NO: 2656 - DNA, 1163 bp, Homo sapiens
tgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaatcattgtttttctt

SEQ ID NO: 2657 - DNA, 907 bp, Homo sapiens
ctgaccgaccttcagcagggctgtggctaccatgttctctcgcgcgggtgtcgctgggctgtcggcctggaccttgcagccgcaatgtcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctgtgagtaattgtagattgtcg

SEQ ID NO: 2658 - DNA, 932 bp, Homo sapiens
cagatgcagtcgaagccctgtggctccaccccgagggtccagcccttaccactgctaagaactacaactcccagcccgagggaggtctctgcgcctgcggcctgacgccctacgcctacacttcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaatctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagatca

SEQ ID NO: 2659 - DNA, 598 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatgggggggtcaccggcctgttgctactgcaactccacaccattcttggtgctggggtgtgttaagctttaccattaaacacaacgtttctctaaa

SEQ ID NO: 2660 - DNA, 614 bp, Homo sapiens
gagaccaagggctaaagctgggaggtgagtctgtcaccttgagccgggcgagcgctgtgggccaagcaggggttgcagggtagtaggagtgcagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatgggggggtcaccggcctgttgctactgcaactccacaccattcttggtgctggggtgtgttaagctttaccattaaacacaacgtttctcta

SEQ ID NO: 2661 - DNA, 1792 bp, Homo sapiens
attcctgtaatggcgtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgctgatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacag

SEQ ID NO: 2662 - DNA, 878 bp, Homo sapiens
ccacgttacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagatgtt

SEQ ID NO: 2663 - DNA, 745 bp, Homo sapiens
tgtgacgactgcgcatgctcggaaaggggacgcaagtccgagatcccaaacgcggtacagaccaaaccgcagtccacgttacggatcggcttactccgcggagttggcctcatttctgcagtcggcgctccctgtagtttctcctctcgaacgccagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatac

SEQ ID NO: 2664 - DNA, 5484 bp, Homo sapiens
ctaaaaaaagaatcccaggattttacctcctgtgtgttttcttcttgcttcttcatggtccatgataccagctgaggttgttagtacaataaaaccaaaccggccggatagaagcagattattctgccatttttccagatgtttgagttgcacatcaaatctggggctgattactcaacgcttgtttagcctacctgtgaggttcacaacaatttttcccagctctgtaatcatcagtgattcaaatttgccaatgtaaccatacttcaccattacagtgagaaaccagatgatgattttggagcacagcctaataagaacctggggtttgcctcttctttcggcattgttgatgctcttgagagcatcaggcaggacattcatgtgcaccattgtggcggcacgaaaagatggcggaaagagccaaacgacaaccctttcattgctcttgacaccgtgggtcaggaatttgggtaaagctcatttggatggctcatttttgttcctcgtggtgttgggaaggcttgacgagagctagagatccaagaaggcctcactcatgtgttggacacctcagttctctttggacttttttctatccaagtggtttctggagagggctatatttgggagtgatctgtcatacttctctttgctatcggatttctatcttcatcatgccatcatcactcaggctatcatcatcacccggtcttatcagatattgccaaattatgatgtcataacttactatgactgtccccactgtccatgaaaaaacacagaaaagattagatacttctcagggaggtccctgttcatctttatggcctcactttagtcctctcagaaggtactctttttcttcaatcttcctcagtgcaaatatccaccctcaatcaacatcaacatgggttggtgttactccaattcactcctctttttcttttctttttttttttgtttttgtttttttgagatggagtctcgctctgtcacccaggctggagtgcagtggcgtgatcttggctcacggcaacctctgactcccaggttcacgccattctcctgacttagcctcctgagtagctgggactacaggcacctgccacaacgcttggctaattttttgtatttttagtaaaaagacggggtttcaccgtgttagccaggatggtctccatctcctggccttgtgatccgcccgccttggcctcccaagtgccgggattacaggcgtgaaccaccgtgcctggccttcattctcctctttctataacgcaatcttaggatgcaaaaccaagcaaagtctgaattaatctatctagaatagcaccgtggagtcacagccatggtcaggcccctccaaagaacagactggatttcggaacccatgtctctccctgccacaagcaactagtccatatgcaacttggaagcagccactgtggatcttggcttctttcttgcttcctcctcaatagttactgccactgatttagtgctaaagagataggaacatcacttaaaaccatctctacacataaatccacttagaataattttttcccctggaggatctattattgaagtacaaggctttactgtttattctactgtagacaccacaggacaccatgttcttggttagaattgagtacttgagaaactatatgaataattgcttgttgaacagtacacgtgaattatctctattttccagctaaagattgagcctaaaatgattagtatttttgtaattttgaatcatttgatccatttgaagttggattagtgacaaagtcttattcatttttcaagtgttagttctgagggcttctcccagaactagcagcaaccagcgttgctgctagataatattgcacctttaagctaacaagtaaaaagctgatcctctgggttgatgttgtctcatgctagggctctaggcagagtgggctggagttcagtccccagccatcttcttagcagggcattctagatgtttaatcttttatgttgacgtgttgatatcacttccattagccatttgttagaattactaaattaaatttacataattcaaggatctaaaaagaccagaagttcagtcagagccatttttctgagatatttctgcatccctctgaagaagataatttgtccaaacttaacaaaaacaggtgttaaaattgagtacgttctgagaatactcagactttttttaagactttttttagtctcaaaccctacatgaaatacaatcccttaaatcttccaatcttagagctagaagaaaagtcgagcaccctcactttacccagaggcaattttgtgccccagatgacaaagctcttagatctactcatttgcttatggctccaccagtacttctaggtcaggccctctttcacctgaaggattagccatacttctggaaccattttccaggttccttgaaataaatatcttcgctttgctggggaccctagtttcctgttaagtagtgaatgacccttctttcctcccgccagccacagtcctatttcacagaggaagagaatgaccagcaagtcaacttctactacagagaagcagcaactgataaaaggccaaatcttacaaggtgccaacgtgaagaaaaaggcccactatcctgcagccaactcatatcaaaagttaatctgtttagtcctctctgccggggtgaatctacagtttttctttttgtctccctcttgccccatcaccaggtggttgtcgttgtccttcccggctagttgccaataaagttgttacaaagtgaccttgagtgtcttccttggtgcacccgaaaccccgccttcttcatccgggtgctgcggcgcgaataagagccggaccgcgcttgcgcattgagtcccactccttcgacctctgccgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtcccattcagaggaagctacagcagttgctccactgatgaaaaatattccaatgtaatttttatgggaattcttttatatagtgttctgcatattgtaattcatagggcttttgtttattcatataaaggataaatatttgggtgttttgagcttctataaaatatgattaattaaaggtagttaatactcaagatggtcttgagtttttaaggtctaacatcagttagaatacttcaaatcagaatcaccttccaagactgacttgacaggtggttctaaaaataaatcacgtcagctttttaggaaatgaagccttaagctagggggtaatgtgacttttgtttttcagtaagtctcacattaagcaattgtgtgcctctaatgaatcttccatgtcttttcagaacaggctcagtccaactagcagctagtttcttacttgaacaagactattaaaaaccaaatatcaaaaaactgaattggctagatttttacagccaaaaattgctgtaaggcagtgtgtatcactgttgctaacatgtttatagtgggagtcttggggatgatagctggttcaacagtattttgctgctaatactttatgttgcttcttggtcaaacttttcccattcaaaggaagaagatggtgctactatagacagtttttcccctagcaaatatattgtaccataatatctatcatccaagtttcagggttttttgaaagttgataattaggaaagtgacattttacttttcttagtgccctttgcctgtttgatttccattgagaaagagcagtcaccaaagttcctcaagtgtcggaagaccacctccatcagaatcagtgcttgtttaaaaaataaaaatccctaggttccagacctactgaattggactctttggacatgagactcagcaatctacatctttaaaaaggcttcccaggtggtttttgtgcatactgtttgagagtcactaagttatatatatatcctaccttctgtaaagtgaaatgaggccccaaaaagctaaagaggtagagctgctacctcgtttttagttgattcatcatctagtctatatcacccaaaagaattggaaataggtattcaaacaaaaacctgtatacaagtattcatagaagcactacttacaatagccgaaaggtagaaacaaccaaatgtctatcagctgatgaatggataagtaaaatacatccatataatggaatattcagccatgaaaaggaatgaggcactgatacataatgaatagatgtgagtgaaccctaagaaagcatgctaagtggaagaagccagccacatgattccatttatatgaaatatccaaaataggcaaatccacggtgacaaagccaattagtagttatcaggaactagggagggggtgaaaagggagtgactgcgtaatgcgtatggggattccttttaggatgatgaaaattggatgaattacagctggtctgatggtagtgggttatcagaacttattaacattagtgtcattaaagttggtatatagcccctcactgctaaatctggctcaaaaattaaaagattattaaaatttgatgaattagtggtgatggttgcacaacattgtaaatataataaatgtcactgaattgtacactttaaggtggttaaaatggcaaattttacatgtcttactgaaactactatttaatacaaagtacatagtataaaattttaaaagtgataggaaaatgcttagattaatattcacctattccaagtatattttaaataaaaacagtcttggtaaaga

SEQ ID NO: 2665 - DNA, 842 bp, Homo sapiens
ctgggaaggtaagtggagggcacagggagcccggcctggccagggcggagcggcgcccagtagggacccattcattgtgccggcgcctcactgggcacggggcccaagctgacggcgtgcacgggagcctgcggggcctgggtgggaagaacaggcccctggagggcacttgaccttaagcctcttttcctccgcagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 2666 - DNA, 795 bp, Homo sapiens
agtcccactccttcgacctctgccgcagcccgtgccgccgccgcctcctgggaagcctcttttcctccgcagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtccca

SEQ ID NO: 2667 - DNA, 365 bp, Homo sapiens
agctccgcctttgcctccaaggctttgctggcttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgata

SEQ ID NO: 2668 - DNA, 614 bp, Homo sapiens
tgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 2669 - DNA, 826 bp, Homo sapiens
aaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 2670 - DNA, 647 bp, Homo sapiens
cccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 2671 - DNA, 1179 bp, Homo sapiens
gcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 2672 - DNA, 589 bp, Homo sapiens
agagcggaggtggtggcggcggaggctttggcagctcgggactgagtgcaaggaatatgcactgaagaggcagcgaacctactaacctttggccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 2673 - DNA, 589 bp, Homo sapiens
tagacccgtccggtcgcagactgtctccgagacgcttcctgtccggtgagcgtcgaccgactgaaacggcggcccataatgcattgcgatggcggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 2674 - DNA, 4380 bp, Homo sapiens
ctgcgcgtgctgggagccggctggcaaggcgtgcggtgggcggggcgccgcgctgacgttgcccgggatgcggacaggttccgccgcctccagcgccgccgccgcagctgccgccgccgccgcctccgcctcgcctgccaccggggtttgtatgaaaacaccgggcggcgggcggcgagggatccgccgtgatccaggtgctgagccgggtgctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaattgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgc

SEQ ID NO: 2675 - DNA, 4393 bp, Homo sapiens
gggtttgtatgaaaacaccgggcggcgggcggcgagggatccgccgtgatccaggtgctgagccgggtgctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgtt

SEQ ID NO: 2676 - DNA, 787 bp, Homo sapiens
ggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaat

SEQ ID NO: 2677 - DNA, 914 bp, Homo sapiens
cggggtttgtatgaaaacaccgggcggcgggcggcgagggatccgccgtgatccaggtgctgagccgggtgctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaagaatgtctggcagtcaggactctggatcctcttgtcaatacctccagtctgataatgaggaagtgtttcccaaaaaatcgactgccactcccaacaattaaaagt

SEQ ID NO: 2678 - DNA, 4205 bp, Homo sapiens
gctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaattgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgtt

SEQ ID NO: 2679 - DNA, 4222 bp, Homo sapiens
ctgcgcgtgctgggagccggctggcaaggcgtgcggtgggcggggcgccgcgctgacgttgcccgggatgcggacaggttccgccgcctccagcgccgccgccgcagctgccgccgccgccgcctccgcctcgcctgccaccggggtttgtatgaaaacaccgggcggcgggcggcgagggatccgccgtgatccaggtgctgagccgggtgctgcggctctgcgcggtccccgccagcgccccatcctgagccgccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaattgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagata

SEQ ID NO: 2680 - DNA, 2317 bp, Homo sapiens
tctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatgccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagata

SEQ ID NO: 2681 - DNA, 4640 bp, Homo sapiens
agctggttcccgtggggcctcatgggatggttgtcgtatccttctgaggtcctttaaggaccgtctcggacctgggaacccccggaggaaaggtcaccccggtcttctcccacgccctacctcagtgccgcccccaagcgccccgcagcccttagtatctagaggattaacctccaagggcgtcccgggcctcgccttggcgtccggcccggcctgggcccttagggtctgcttagctcttccccaagactcgtgccattcccgagggaatctttgtcggcatcctggtcactgtgggggtttgaggtcgtcccggaagacttcagaaccaggcgaacctagacgaaggcggctggaatgaaccaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctatagcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatattttatgtttctttttagcttctcttaaaatcagaatattgaacagaattctgatatgctgaatatatatagtgcatggctgaaactccagcaccaactgggtgcttcaaatgaagtcatagaataattccatctagagctgacagaaatctttcagagccttcattattaaatttgttatagatttagttatcaaagatagagttctctaatcttttttttaaagctaaagttctctttatttacatgtataggaaaacattctgcctaaatcatgatgttaatgaaaatcatattgaggagaacttgaaccttattaaatatgagcttctaacataa

SEQ ID NO: 2682 - DNA, 2939 bp, Homo sapiens
gtatttttcaaataaaatgattaattctactaccaaataaatcttaatttctagtctacttctagtttgcaagaggagctttaaatgtatttgtttacttaacatttaaaaatccatttctccttaaaatgaaacactttttttaaggtaggtaatattttaatttgactagaagttagtttttctttcttagtttaagctactttgttagtcttacaattttaataagtatagttattacctagtgacatttctgtttgtttttttaaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctcttta

SEQ ID NO: 2683 - DNA, 1277 bp, Homo sapiens
aggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatg

SEQ ID NO: 2684 - DNA, 1243 bp, Homo sapiens
agctggttcccgtggggcctcatgggatggttgtcgtatccttctgaggtcctttaaggaccgtctcggacctgggaacccccggaggaaaggtcaccccggtcttctcccacgccctacctcagtgccgcccccaagcgccccgcagcccttagtatctagaggattaacctccaagggcgtcccgggcctcgccttggcgtccggcccggcctgggcccttagggtctgcttagctcttccccaagactcgtgccattcccgagggaatctttgtcggcatcctggtcactgtgggggtttgaggtcgtcccggaagacttcagaaccaggcgaacctagacgaaggcggctggaatgaaccaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatctgaggaaactgaaacccagagaagttttgtaa

SEQ ID NO: 2685 - DNA, 5565 bp, Homo sapiens
cgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattccctcgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaa

SEQ ID NO: 2686 - DNA, 2330 bp, Homo sapiens
gggagccctggcccttgccgctcctcgccgctgtcggcagccacttcccgggcgagactgcgcccccggagcacccccggccggagccgtgtcgcgtgccgggaggatcggactctttccgtcacccgtttgcacctctgcagctgtcaggagcgggtcaggttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 2687 - DNA, 2612 bp, Homo sapiens
accggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaaatgcggctggaagccctgagcctgctgcacacactagtctgggcatggagtctctgccgtgccggagccgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 2688 - DNA, 2492 bp, Homo sapiens
ggcgcctgcgcagtggcggtgaccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 2689 - DNA, 2689 bp, Homo sapiens
accggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaaatgcggctggaagccctgagcctgctgcacacactagtctgggcatggagtctctgccgtgccggagccgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaaccccagtcacgtgtcacacggaggatcaagtcctgctggtcggccgtggctgactcctcaggcacgttgggctcccaggttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctc

SEQ ID NO: 2690 - DNA, 603 bp, Homo sapiens
aaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaaccccagtcacgtgtcacacggaggatcaagtcctgctggtcggccgtggctgactcctcaggcacgttgggctcccaggttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcag

SEQ ID NO: 2691 - DNA, 498 bp, Homo sapiens
gctgatggcgcgtcggagtccccggcgctccgcccagtcggcccagactgcagctcccggctgagatgtgtctttgccgccctcttctcccccagagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctact

SEQ ID NO: 2692 - DNA, 403 bp, Homo sapiens
ggtgtccggcctccctcccggggggccttcgcgggcttctgctggtgcttctgtgcctgtgggtctggattcctccagggcctgatcctgggtgcagatgcggctggaagccctgagcctgctgcacacactagtctgggcatggagtctctgccgtgccggagccgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcag

SEQ ID NO: 2693 - DNA, 2332 bp, Homo sapiens
gggagccctggcccttgccgctcctcgccgctgtcggcagccacttcccgggcgagactgcgcccccggagcacccccggccggagccgtgtcgcgtgccgggaggatcggactctttccgtcacccgtttgcacctctgcagctgtcaggagcgggtcaggttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctcatt

SEQ ID NO: 2694 - DNA, 2448 bp, Homo sapiens
cgcctgcgcagtggtcctggccaccggctcgcggcgcgtggaggctgctcccagccgcgcccgagtcagactcgggtgggggtcccggcggcggtagcggcggcggcggtgcgagcatgtcgtggctcttcggcgttaacaagggccccaagggtgaaggcgcggggccgccgccgcctttgccgcccgcgcagcccggggccgagggcggcggggaccgcggtttgggagaccggccggcgcccaaggacaaatggagcaacttcgaccccaccggcctggagcgcgccgccaaggcggcgcgcgagctggagcactcgcgttacgccaaggaggccctgaatctggcgcagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtcagccggcggctcctcagtcgaccccaggacgtgctggagggtgttgtgcttagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctca

SEQ ID NO: 2695 - DNA, 2138 bp, Homo sapiens
gtgtttcgcctgcgcagtggtcctggccaccggctcgcggcgcgtggaggctgctcccagccgcgcccgagtcagactcgggtgggggtcccggcggcggtagcggcggcggcggtgcgagcatgtcgtggctcttcggcgttaacaagggccccaagggtgaaggcgcggggccgccgccgcctttgccgcccgcgcagcccggggccgagggcggcggggaccgcggtttgggagaccggccggcgcccaaggacaaatggagcaacttcgaccccaccggcctggagcgcgccgccaaggcggcgcgcgagctggagcactcgcgttacgccaaggaggccctgaatctggcgcagatgcaggagcagacgctgcagttggagcaacagtccaagctcaaacaacttctcaatgaggagaatttacggaagcaggaggagtccgtgcagaagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccagcaggtcagccggcggctcctcagtcgaccccaggacgtgctggagggtgttgtgcttagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctc

SEQ ID NO: 2696 - DNA, 510 bp, Homo sapiens
agggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtaaacatattcataaaacagggctggcaggtggctgagaggcagcattttcggaggcggaggtgggcggatcacgaggtccggagatcgagatcatcctggtaagagtgaaaccctgtctctactaaaaaaaagaaaaaaaaa

SEQ ID NO: 2697 - DNA, 2510 bp, Homo sapiens
gtgtttcgcctgcgcagtggtcctggccaccggctcgcggcgcgtggaggctgctcccagccgcgcccgagtcagactcgggtgggggtcccggcggcggtagcggcggcggcggtgcgagcatgtcgtggctcttcggcgttaacaagggccccaagggtgaaggcgcggggccgccgccgcctttgccgcccgcgcagcccggggccgagggcggcggggaccgcggtttgggagaccggccggcgcccaaggacaaatggagcaacttcgaccccaccggcctggagcgcgccgccaaggcggcgcgcgagctggagcactcgcgttacgccaaggaggccctgaatctggcgcagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtcagccggcggctcctcagtcgaccccaggacgtgctggagggtgttgtgcttagtgtaagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggtctgcaggaggagataagcaaggacctcagagccacactgaacgccttcctgtaccacatgggccaacacagcaacaacagattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacgcatgggtgtaggccagctgcctgtcttccggcctccacctcatggtgtggggtccgcggccttggctgcctcacttgggaactccttccccaggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctc

SEQ ID NO: 2698 - DNA, 980 bp, Homo sapiens
gtgtttcgcctgcgcagtggtcctggccaccggctcgcggcgcgtggaggctgctcccagccgcgcccgagtcagactcgggtgggggtcccggcggcggtagcggcggcggcggtgcgagcatgtcgtggctcttcggcgttaacaagggccccaagggtgaaggcgcggggccgccgccgcctttgccgcccgcgcagcccggggccgagggcggcggggaccgcggtttgggagaccggccggcgcccaaggacaaatggagcaacttcgaccccaccggcctggagcgcgccgccaaggcggcgcgcgagctggagcactcgcgttacgccaaggaggccctgaatctggcgcagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtaaacatattcataaaacagggctggcaggtggctgagaggcagcatcattttcggaggcggaggtgggcggatcacgaggtccggagatcgagatcatcctggtaa

SEQ ID NO: 2699 - DNA, 6277 bp, Homo sapiens
gcaggacggcgcgaaaacccaattgacaagaattccctccgaagctctgtggtccgatctgcggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatctgggcccagcctccgctcccgctctctgtcggtgggcgcgggggaatccgaaacggctcagcagaatcccagcagcttgctgctactggagcgggccgcctccatggcctccaggcaggccgggctggaccgcgtgaggtcctaggagacgggattccgggaagcggggagtatggtgggggtcctggccatggcggctgcagctgctccgcctcccgtgaaggactgcgagattgagccatgcaaaaagcgaaagaaagatgatgacacatctacctgcaaaacaattacaaaatatttatcaccactagggaagactagagacagggtttttgctccaccaaaacctagtaatattctggattattttagaaagacttcacccacaaatgagaagacacaattagggaaagagtgcaagataaagtcacctgaatcagtacctgttgacagcaacaaagactgtacgacacctttggaaatgttctcaaatgtagagtttaagaagaaaagaaagagggttaatttatctcatcaactaaataatattaaaactgaaaatgaagctccaattgaaattagtagcgacgatagcaaagaagactatagtttaaataatgattttgtggaaagtagtacttctgttttacgttacaagaaacaagtagaggtacttgcagaaaacattcaagatacaaaaagtcaaccaaatactatgacctccctgcaaaattctaaaaaagtaaatcctaaacaagggaccacaaaaaatgacttcaaaaagttgagaaaaaggaaatgcagagatgtagtagatctatctgaaagcttacccttggcagaggaactaaatttgcttaaaaaagatggtaaagatactaaacagatggagaatactacaagccatgcaaactctagagataacgtaactgaagcagcccagttaaatgatagtataataactgtctcatatgaggaatttttaaaaagtcacaaggaaaataaagtggaagagataccagactctacaatgtcaatttgtgttccttctgaaactgtcgacgaaatagtcaaaagtggttatataagtgaatcagaaaactccgaaatttcccagcaggtacgctttaagacagttactgttcttgcacaggttcaccctattccgcccaaaaagacagggaaaataccccgaattttcttgaaacaaaagcaatttgaaatggaaaatagtttatctgatcctgagaatgaacagacagttcagaaaagaaaatctaatgttgttatacaggaggaagaattagaattggctgttttggaagctggaagttctgaagctgtgaaaccaaaatgcactctagaagaaagacagcaatttatgaaagcatttaggcagccagcatcagatgcacttaaaaatggagttaaaaagtcttctgataagcagaaagaccttaatgaaaaatgtctatatgaagtaggaagagatgataattctaaaaaaatcatggaaaattctggtatccaaatggtttcaaaaaatggcaatttacagttacacactgataaaggaagttttctgaaggagaaaaataaaaagctaaagaagaagaataagaaaacattagatactggggctattccaggcaaaaacagagagggaaacactcaaaagaaagaaacaacctttttcttaaaagagaaacaatatcaaaatagaatgagtttaagacaaaggaaaacagagtttttcaaaagcagcactttatttaacaatgaaagtcttgtttatgaagatatagcaaatgatgaccttctaaaggtttcctctctgtgtaacaataataaattgtcaagaaaaaccagcataccagttaaagatattaagcttacacagtctaaagctgaatctgaagccagcttgctaaatgtttccacgcccaagtcaactagaagatctggaagaattagcagcacacctactacagaaaccattagaggtattgattctgacgatgtacaagataatagtcaactaaaggcttccactcaaaaagcagccaacttatcggaaaagcacagcttatatacagcagaattaataacagtaccctttgattcagagagccctattagaatgaaattcaccagaattagtactcccaaaaaatctaagaaaaaatctaacaaaagatctgagaaatctgaagcaactgatggaggttttacttctcagattagaaaggcaagcaatacttcaaaaaacatatcaaaagcaaaacaattgattgaaaaagcaaaagctttacacatcagtaggtcaaaggtgactgaagaaatagcgatacccttaaggcgctcctctagacatcagacacttcctgaaaggaagaaattgtcagaaacagaagattctgttataataatagattcaagtcctactgctttaaagcatccagagaaaaatcagaagaaacttcagtgtttgaatgatgtgctaggaaaaaaacttaacacatccactaaaaatgtacctggaaaaatgaaagtcgctcctttatttcttgtcagaaaagcacaaaaagcagctgatcctgtccctagttttgatgaaagcagtcaagatacatctgaaaaatctcaggattgtgatgttcaatgtaaagcaaagcgtgacttcctaatgagtggtttgccagatttgttgaaacggcaaattgcaaagaaagctgctgcgctggatgtgtacaatgcagtgagtaccagtttccagagagtcgtacatgtgcaacaaaaggatgatgggtgttgtttgtggcatttgaaaccaccctcttgtcctctcttaactaaatttaaagaactgaacactaaagtaatagatctctcaaaatgtggtattgctcttggtgaattttcaacattgaattcaaagttgaaaagcggtaactctgctgctgtgttcatgaggacaaggaaggaatttactgaagaagtaagaaatcttttgcttgaggaaattaggtggtcaaatcctgaattttcattgaaaaaatattttcccttactcctaaaaaaacaaattgagcaccaagtactttcttccgagtgtcatagtaaacaagaactggaggctgatgtcagccataaagaaaccaaaaggaaactcgtagaagcagaaaattctaagtcaaaaagaaagaaaccaaatgagtattcaaaaaatctggagaagaccaataggaagtcagaagaacttagcaaaagaaacaactcttctgggataaagctagattcttccaaagattctggaactgaagacatgctttggacagaaaagtatcaacctcagactgccagtgaacttataggaaatgagttagctataaaaaagttacatagttggttgaaagactggaaaagaagagctgaattggaagaaaggcagaatctgaagggaaaaagagatgagaaacatgaagatttctcgggtggcatagactttaaaggcagttcagatgatgaagaagagagtcgtctttgcaatactgtccttataacagggccaacaggagtgggaaaaactgctgcagtgtatgcttgtgcccaggagcttggatttaagatatttgaagtgaatgcctcttcccagcgcagtggtagacaaattctatctcagttgaaggaagctactcagtcccatcaagtagacaaacaaggtgtaaactcacaaaaaccctgtttttttaatagctactacataggcaagtcaccaaaaaaaataagctcccctaagaaagttgttacatcaccaagaaaagttcctccaccatcaccaaaaagtagtggaccaaagcgagcacttcctcccaaaaccttggcaaattattttaaagtatctcccaaacctaaaaataatgaagaaataggaatgcttctggaaaataataaaggaataaaaaattcttttgaacagaaacaaattactcagactaaatctacaaatgcaactaattcaaatgtcaaagacgttggagctgaagaacccagcagaaaaaatgcaacatctcttattctttttgaggaggttgatgtaatttttgatgaagatgctgggtttttgaatgcaatcaaaacattcatggcaacaactaaacgacctgtaatccttactacaagtgacccaacatttagtttaatgtttgatggctgctttgaagaaatcaagttcagtactccttccctgctaaatgttgccagctacctacaaatgatttgcttaactgagaattttagaactgatgtaaaagactttgtaaccttgttaactgcaaatacttgtgatatcagaaaaagtatcctttacttacaattctggattagaagtggaggtggagttttagaagaacgaccattaaccctttatcgtggaaatagcagaaatgtacaactagtttgctctgaacatggccttgataacaaaatttaccctaaaaatactaaaaagaaacgtgtagaccttccaaaatgtgacagtggctgtgctgagaccttgtttggccttaagaacattttttccccatctgaagacttattttcatttttaaagcacaaaatcacaatgaaggaagaatggcataaattcatccagcttcttacagaattccaaatgcggaatgtagattttttatatagtaatcttgagtttattctaccattaccagttgataccattccagaaactaaaaacttttgtggcccatcagtaactgtggatgccagtgcagcaacaaaaagtatgaattgtcttgctaggaaacactctgaaagagaacagccattgaaaaagtcccagaaaaagaaacaaaagaaaacattggtaatattagatgatagtgatctatttgacactgacttggactttcctgatcaatctattagcctgtcctctgtatcatcttcctcaaatgcagaagaaagcaaaaccggagacgaagaaagcaaagccagagacaaaggaaacaatccagagacaaagaaatctattccttgtcctcctaaaacaactgcaggaaaaaaatgttctgcccttgtttctcattgtttaaattctctctctgagttcatggataacatgtccttcttagatgcacttttaactgatgtaagggaacaaaacaaatacggtagaaatgactttagttggacaaatggaaaggttacaagtggactttgtgatgagtttagtcttgagagtaatgatggatggacttctcaaagctctggagaattaaaggcagctgcagaagctctcagctttactaaatgttcttctgctatttcaaaagcattggaaaccttgaattcttgcaagaaattaggaagagatccaaccaacgatcttactttttatgtttcacaaaagcgcaataatgtatactttagtcagtcagcagctaatttagacaatgcttggaagaggatatcagtcattaaaagtgtattttcgagtcgatctcttctctatgtgggtaatagacaagctagtataattgaatacctgccaacccttcgaaacatctgtaagactgagaagctaaaagaacaaggaaaaagtaaaagaagattcctgcactattttgaaggaattcatcttgacattccaaaagagactgtgaatactttggcagctgacttcccttaatgttccatactaacaatgctttgtatagattatcatgtggtccttaagatacatttttatattatgtggatcttcatggaaaagtatatttctcgatgtacattttaaacaaacaatttgtatatttttttattggcgggtaaatatttaaaatatttgagttacaaattttatatatgattgtaattttttttctgaattttttgtattatctgatttagctttgttggagtattttttgtatgtgagtgaactgtttctggaaggtagagttcattaagatgaactccctatttcaagtgtttatattatatattagcttaatattcagatacattatcttggctgctaacattagtgtcac

SEQ ID NO: 2700 - DNA, 3840 bp, Homo sapiens
gcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacccccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 2701 - DNA, 3681 bp, Homo sapiens
cgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcgaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacccccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 2702 - DNA, 3981 bp, Homo sapiens
agtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcgaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacccccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 2703 - DNA, 3674 bp, Homo sapiens
aggacctgttcgttcttctttgggctataagaaggcagaggatgagatgtcccgggccacgtctgttggagaccagctggaggcacccgcccgcaccatttacctcaaccaaccgcatctcaacaaattccgcgacaaccagatcagtacggccaagtacagcgtgttgacatttctacctcgattcttgtatgagcagattagaagagctgctaatgccttctttctcttcattgccttattacagcaaattccagatgtatctccaacaggaagatataccaccctggtgccattgatcattattttaacaattgcaggcatcaaagagattgtagaagattttaagcgacacaaggcagacaatgcagttaacaaaaagaaaacaatagtgttaagaaatggtatgtggcataccattatgtggaaagaggtggcagtgggagacattgtgaaggtcgtcaatgggcagtatcttccagcagatgtggtcctgctgtcatccagtgaacctcaggcaatgtgttatgttgaaacagctaatctggatggggagacgaaccttaaaatacgtcagggtttgagtcacactgctgacatgcaaacacgtgaagttctgatgaagttatctggaactatagagtgtgaagggcccaaccgccacctctatgacttcactggaaacttgaacttagatgggaaaagccttgttgcccttgggcctgaccagatcttattaagaggtacacagcttagaaatactcagtgggtctttggcatagttgtttatactggacacgacaccaaactcatgcagaattcaaccaaagcgcctctcaagagatcaaatgttgagaaggtgactaacgtgcagatcctggtgttgtttggcatcctcttggtcatggccttggtgagctcggcgggggccctgtactggaacaggtctcatggtgaaaagaactggtacatcaagaagatggacaccacctcagataattttggatacaacctactgacgttcatcatcttatacaacaatcttattcccatcagtctgttggtgactcttgaggttgtgaagtatactcaagcccttttcataaactgggacacagatatgtattatataggaaatgacactcctgccatggccaggacatcaaaccttaatgaagagcttgggcaggtgaaatatctcttttctgacaagactggaacgcttacatgcaatatcatgaactttaagaagtgcagcattgccggagtaacctatggtcacttcccagaattggcaagagagccgtcttcagatgacttctgtcggatgcctcctccctgtagtgattcctgtgactttgatgaccccaggctgttgaagaacattgaggatcgccatcccacagccccttgcattcaggagttcctcacccttctggccgtgtgccacacggttgttcctgagaaggatggagataacatcatctaccaggcctcttccccagatgaagctgctttggtgaaaggagctaaaaagctgggctttgtcttcacagccagaacaccattctcagtcatcatagaagcgatgggacaggaacaaacattcggaatccttaatgtcctggaattttctagtgacagaaaaagaatgtctgtaattgttcgaactccttcaggacgacttcggctttactgtaaaggggctgataatgtgatttttgagagactttcaaaagactcaaaatatatggaggaaacattatgccatctggaatactttgccacggaaggcttgcggactctctgtgtggcttatgctgatctctctgagaatgagtatgaggagtggctgaaagtctatcaggaagccagcaccatattgaaggacagagctcaacggttggaagagtgttacgagatcattgagaagaatttgctgctacttggagccacagccatagaagatcgccttcaagcaggagttccagaaaccatcgcaacactgttgaaggcagaaattaaaatatgggtgttgacaggagacaaacaagaaactgcgattaatatagggtattcctgccgattggtatcgcagaatatggcccttatcctattgaaggaggactctttggatgccacaagggcagccattactcagcactgcactgaccttgggaatttgctgggcaaggaaaatgacgtggccctgatcatcgatggccacaccctgaagtacgcgctctccttcgaagtccggaggagtttcctggatttggcactctcgtgcaaagcggtcatatgctgcagagtgtctcctctgcagaagtctgagatagtggatgtggtgaagaagcgggtgaaggccatcaccctcgccatcggagacggcgccaacgatgtcgggatgatccagacagcccacgtgggtgtgggaatcagtgggaatgaaggcatgcaggccaccaacaactcggattacgccatcgcacagttttcctacttagagaagcttctgttggttcatggagcctggagctacaaccgggtgaccaagtgcatcttgtactgcttctataagaacgtggtcctgtatattattgagattttcaccgctttgccgcccttcactctgggaatctttgagaggtcttgcactcaggagagcatgctcaggtttccccagctctacaaaatcacccagaatggcgaaggcttcaacacaaaggttttctggggtcactgcatcaacgccttggtccactccctcatcctcttctggtttcccatgaaagctctggagcatgatactgtgttgacaagtggtcatgctaccgactatttatttgttggaaatattgtttacacatatgttgttgttactgtttgtctgaaagctggtttggagaccacagcttggactaaattcagtcatctggctgtctggggaagcatgctgacctggctggtgttttttggcatctactcgaccatctggcccaccattcccattgctccagatatgagaggacaggcaactatggtcctgagctccgcacacttctggttgggattatttctggttcctactgcctgtttgattgaagatgtggcatggagagcagccaagcacacctgcaaaaagacattgctggaggaggtgcaggagctggaaaccaagtctcgagtcctgggaaaagcggtgctgcgggatagcaatggaaagaggctgaacgagcgcgaccgcctgatcaagaggctgggccggaagacgcccccgacgctgttccggggcagctccctgcagcagggcgtcccgcatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcatt

SEQ ID NO: 2704 - DNA, 476 bp, Homo sapiens
gacctgttcgttcttctttgggctataagaaggcagaggatgagatgtcccgggccacgtctgttggagaccagctggaggcacccgcccgcaccatttacctcaaccaaccgcatctcaacaaattccgcgacaaccagatcagtacggccaagtacagcgtgttgacatttctacctcgattcttgtatgagcagattagaagagctgctaatgccttctttctcttcattgccttattacagcaaattccagatgtatctccaacaggaagatataccaccctggtgccattgatcattattttaacaattgcaggcatcaaagagattgtagaagattttaagcgacacaaggcagacaatgcagttaacaaaaagaaaacaatagtgttaagaaatggtatgtggcataccattatgtggaaagaggagaattcgccaccctttaaagaaatttctcctttatagtgtttt

SEQ ID NO: 2705 - DNA, 9575 bp, Homo sapiens
acaggcgccggcggtccccgccagctagcagcccggcgaggcgctggcccacccatggtcctcgggcggcggcccctgcgcccagccctgcgcgtagcctccgtctctcgcccggggccgccgagcccccgacacgggcgagatgctgaacggcgcaggcctggacaaagctcttaagatgtccctgccgcggaggtcgaggatccgctcgtccgtgggacctgttcgttcttctttgggctataagaaggcagaggatgagatgtcccgggccacgtctgttggagaccagctggaggcacccgcccgcaccatttacctcaaccaaccgcatctcaacaaattccgcgacaaccagatcagtacggccaagtacagcgtgttgacatttctacctcgattcttgtatgagcagattagaagagctgctaatgccttctttctcttcattgccttattacagcaaattccagatgtatctccaacaggaagatataccaccctggtgccattgatcattattttaacaattgcaggcatcaaagagattgtagaagattttaagcgacacaaggcagacaatgcagttaacaaaaagaaaacaatagtgttaagaaatggtatgtggcataccattatgtggaaagaggtggcagtgggagacattgtgaaggtcgtcaatgggcagtatcttccagcagatgtggtcctgctgtcatccagtgaacctcaggcaatgtgttatgttgaaacagctaatctggatggggagacgaaccttaaaatacgtcagggtttgagtcacactgctgacatgcaaacacgtgaagttctgatgaagttatctggaactatagagtgtgaagggcccaaccgccacctctatgacttcactggaaacttgaacttagatgggaaaagccttgttgcccttgggcctgaccagatcttattaagaggtacacagcttagaaatactcagtgggtctttggcatagttgtttatactggacacgacaccaaactcatgcagaattcaaccaaagcgcctctcaagagatcaaatgttgagaaggtgactaacgtgcagatcctggtgttgtttggcatcctcttggtcatggccttggtgagctcggcgggggccctgtactggaacaggtctcatggtgaaaagaactggtacatcaagaagatggacaccacctcagataattttggatacaacctactgacgttcatcatcttatacaacaatcttattcccatcagtctgttggtgactcttgaggttgtgaagtatactcaagcccttttcataaactgggacacagatatgtattatataggaaatgacactcctgccatggccaggacatcaaaccttaatgaagagcttgggcaggtgaaatatctcttttctgacaagactggaacgcttacatgcaatatcatgaactttaagaagtgcagcattgccggagtaacctatggtcacttcccagaattggcaagagagccgtcttcagatgacttctgtcggatgcctcctccctgtagtgattcctgtgactttgatgaccccaggctgttgaagaacattgaggatcgccatcccacagccccttgcattcaggagttcctcacccttctggccgtgtgccacacggttgttcctgagaaggatggagataacatcatctaccaggcctcttccccagatgaagctgctttggtgaaaggagctaaaaagctgggctttgtcttcacagccagaacaccattctcagtcatcatagaagcgatgggacaggaacaaacattcggaatccttaatgtcctggaattttctagtgacagaaaaagaatgtctgtaattgttcgaactccttcaggacgacttcggctttactgtaaaggggctgataatgtgatttttgagagactttcaaaagactcaaaatatatggaggaaacattatgccatctggaatactttgccacggaaggcttgcggactctctgtgtggcttatgctgatctctctgagaatgagtatgaggagtggctgaaagtctatcaggaagccagcaccatattgaaggacagagctcaacggttggaagagtgttacgagatcattgagaagaatttgctgctacttggagccacagccatagaagatcgccttcaagcaggagttccagaaaccatcgcaacactgttgaaggcagaaattaaaatatgggtgttgacaggagacaaacaagaaactgcgattaatatagggtattcctgccgattggtatcgcagaatatggcccttatcctattgaaggaggactctttggatgccacaagggcagccattactcagcactgcactgaccttgggaatttgctgggcaaggaaaatgacgtggccctgatcatcgatggccacaccctgaagtacgcgctctccttcgaagtccggaggagtttcctggatttggcactctcgtgcaaagcggtcatatgctgcagagtgtctcctctgcagaagtctgagatagtggatgtggtgaagaagcgggtgaaggccatcaccctcgccatcggagacggcgccaacgatgtcgggatgatccagacagcccacgtgggtgtgggaatcagtgggaatgaaggcatgcaggccaccaacaactcggattacgccatcgcacagttttcctacttagagaagcttctgttggttcatggagcctggagctacaaccgggtgaccaagtgcatcttgtactgcttctataagaacgtggtcctgtatattattgagctttggttcgcctttgttaatggattttctgggcagattttatttgaacgttggtgcatcggcctgtacaatgtgattttcaccgctttgccgcccttcactctgggaatctttgagaggtcttgcactcaggagagcatgctcaggtttccccagctctacaaaatcacccagaatggcgaaggcttcaacacaaaggttttctggggtcactgcatcaacgccttggtccactccctcatcctcttctggtttcccatgaaagctctggagcatgatactgtgttgacaagtggtcatgctaccgactatttatttgttggaaatattgtttacacatatgttgttgttactgtttgtctgaaagctggtttggagaccacagcttggactaaattcagtcatctggctgtctggggaagcatgctgacctggctggtgttttttggcatctactcgaccatctggcccaccattcccattgctccagatatgagaggacaggcaactatggtcctgagctccgcacacttctggttgggattatttctggttcctactgcctgtttgattgaagatgtggcatggagagcagccaagcacacctgcaaaaagacattgctggaggaggtgcaggagctggaaaccaagtctcgagtcctgggaaaagcggtgctgcgggatagcaatggaaagaggctgaacgagcgcgaccgcctgatcaagaggctgggccggaagacgcccccgacgctgttccggggcagctccctgcagcagggcgtcccgcatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcattcaactgtgctctgtgaggtgtgaaattaaaaacattatgtttcaccaatatttaaacatcagtactagttgtcctgggagaaagggaaaggagttttatgttgcgtgagaggcccatcctgtgtaattggagcagggcacacttgcttcctgttgagttaactcagaggttaagtccaacgggccacatgcagacttcactgtaggcaggttgctctcctgctttgattcctgttttgtgtgtaaaattggcataaacttcttgattgcagtgaaatcacaaaattctctatcggggtggtcaacctgagaacatttatttgaacctcttagccacatttccagcagggcaaaccaactgatgccctggaagagtcttccgcaccctctccaggtgcactcggcccagtcctgccgccgtgtccaggcgcccctcacccccacacctgctgcatggctggccacaccactcagtgcatggcggccgatgggcagccaacccaaacccgcgcctttccttgttccactgcagactcagatacagatgcgaaaaattccttcttccaccgcccttctcgttctgtaaagaaagaaaagaaacatagcctttctgcatatattctaaacgtctctctgcctctgtctgacatggggccaccccacaggtcagagtggtggtagaaccccttcaggactcccagccgtggtcaggctctgaatactcccttcccaacatccagactgctgggcctttggcatccacttacattagaacccacgtttgtttcagagcacattttggactttcactgttgggaaatgaatgaatttataacatgcctgcacagcgaaggaacacacctgtcgctcttagctctagagtcagaggatgagtaaacccagatgcaagagtataggacattgagtggggagaacaagacgaccacagaagtcctcagaaggagaaggaaggacacggagacactgagaggaggacacagaggaatcgccaccagatctttgcagtagaaactctgaaataggccttgagacccagacaattgtcatgatcagcccagtgtgtatgagagcttaaacaagaccttcacacacagttctaattgaaaagaattccaaacatttcagggaaacacctttttaaaaaatatactgacatggtttcctttctgtatcccatcagtgttagacacaggtacctatcagaatacggcatatcctgaattatctaagacaaggaagtgaagagcggaatcactgactttcccaactgcagagtcccacacttaaatctcaacagaacctagatgtcttcaggcatgaatgtgagcacctggagcccttactaaacaacctgcctggagccctgttctctgctctggttgccaaaccagatttttggatggcctaaatacttgtgggcaactgttactggtgaaaaatgggagtggagagcatgttttggattttcactgtggggaaatgaatgaatttatcacatgactgtgcagcgaaggagcacacctgtcactcttagctctagagtcggaggatgagtcaaccctgtaggaatgattgtgctaaattaggaaataacactttagtgcactttgcttcctaacccttttttgtcagaaatctacaacctactgggcatggaaatgatttaaaatatgatctgcattgactaagaaaactcatcctcacttatgaggtgaccaggatgcagagagggcctgaggggcagcagaacaatgcaattcacaggtgaggctccaaaaagggccatttctttctccccaaggtgcatagaacatttttaaatatcagagtacccagcaagacggaaggactgtcatgcaggaactctaacacaaaatgtgcctatgactaacacgacaaaccaaggtgtatggtttctttgcacacccagaaaggtgatggccaagatacagaggagaaacgaaaactggaattgaatgtgcattaggcatcttaactattcatattttgtctcatttgggaactaagcctatttggaaagagtggattagaaattgaattctttgtcaaacagttagctctgtcttgaacttgaagccttccaaatcagaattatgtatttaagtgtgtgtttgtgtttgtttggggtttttgtttcttacattagagttcatattttctgggatttaaggatacaggtgtattttcctattctcttgagaagtagactaaacaatatttgcagtgatgacagacgcacacagaagaaaacattagaagagatgcctttctatcctctcatgtggttgagcattcttacagccaaatgactaaattggctgtaaattggtttctaggaggagcagctgtcactacgtgtgatgtataatatttagccagggccaactcaggggctgtgtcatttgtcctatctttaaattgaggtcagagtgtcacacacaacccctcccctggggcagggtggactggactaggttgcatacgctggctgtcagctcagcaaaaatgccacatggggcttgtcactccgccagacactcactgactcacgggctggcaggtcacgctcggttagcgctccagggcctgactctggattgagctaaactggcagaatccactcaggccaacccttggtctactgctgtgtacagacagcccagtcctgtgttgagtctctcttctcctggatgaccctgcaaaaggaagagaccagttgtactgtgggcttagttctgggtttccactgcacactgacacgtgccagcaagggtagctgtggaaaacacgtatcaggagagcagagtagtctggatgaatactctgtgctgatcagaacgggctcggtcataatttaggagtggagctgatgtgtctgtcctgcctcagtgcagaatattccaggcttcttgaccagggttatgttcacccatctcccaacacacacatgcacacatgaaaacaaaaacatggtaactcttttggttcggcacaccatacaaaacgtgctttggggcgaggagtgctgtttcttttaacacttgtagaggaatatcctgagaagtgaacctgggctttgggagagctcagctgagaattctgttgacattttctttcccttgacaaggcttcaggttcgtctcactatagggagctggctgtgaaaatcagtaataacttgtcaagaagcagtgaaaaatgcgggggggtggaaagagcctaggtaactaatgtcttataatgcatatgtatgtaaatattacaggatttaaggttgaattttttaaaaagaaagttatagtctgtaatttccatttgttataataatgacctttaatcttgtcatttggaaccataaagcatttttatcaggtacctctgttccaagggatttatgtcttagaccatagctgaattgaatgtttgcaaaacactgctataggataaggtggtctttagttttgaacgtgtgaaaggactgcacacttttcagccagggtttgagttactgcccagggtcatcgtctcaaagtaattcaaggagtgatttaacatcagcatttgaaatgtagtcttcatctcctgggatccataaaaaaatgtgaacagggaaatggtggctaagcagagcctgaaataataacttggcaaagaaatgagtttatcaggtcgagtcaaaacatggcatcccctgttacactcaagaaatgttttcttcatgtaaatgtttatacgggcatatataatcacaatgggaacagttaaaaccccctcccttcaaaaaaagaaaatctatatcagttgggtttggttttggttcttcattggctcaaggcagttaactgtctcagtatagccttcggggagatttaacctcattctagccatttttccatcctgaaggccaagaaggactattagaagggtttttgaggggtttcggaggtgagggcccaagacccccataatgacatcattaggcattcttgaaaggtgttaacagaccagcacgctcgatgtgttgtacccttcatttatttttttttctcagcatcccaagttgtccatcagtacattccccttcaccttacctgatcttcatttaatgcccagtctgtaactaatgttctgtttaaagctctcttaatttgttggctatgagtgatttgtgaatctgggatgtaaccctgagtgaggagaaaagggcattgagccagcataaatctgaatgggcagaagccacaaacaaatgggagcagaaaagaagggcgagctcccccgcgccgcaccccgtgtataatccagtgttaacctctgaggaacacctcggctctcccaactgaggagagacaaaagagggattctttttacacccaggctggcgcattttcaagtgacaatctcgggctctagttgcctttgagatatccactctgctctttctcccaggcctcagaccaagaaaaacatgctctcaagattagcccataggcagttcttgtgacctggctgaagaaagaaaggagacctgtttgttttaaaagtcgggcgcaaagtgtcaggtggctttgatttatgacagaaagaggaagaagaaagttggagtaatagcactatccaaataaccctgcccaggaaacttgggggtcaagagagcttatcaagagccttttataggtaagctcttccgtgtgaaagagaaaaggccggaaagagggagagagcccagagagcaggctgcgaactcacttccaatgggattggagtctgttgtattcttaagagatagcctgatatgtggtttataggtgaatcaataaacaccaacaacaacaaaaaaaaaaaaaaaaaaaaaggaagaaaagaaaaaaaggaaaccagccctgtcatggaatttctctccttccctgcacagtaaagacttttgggttttcatggataaaatcaatgtcagtactgaaactcctactctcccctcccgccccactctcccccgttgcccgagatggccaagttcaggcctgtgcaatgccgcttccctctgagcctccctctcaagggccacgcaggcagctgcagcagggccagctgcaggatggggctgccggtcactgaattgtcgttcaaatgcatcatctttgtggcgtctttctcatgcgagcaaagccacgtgctctcctgtctgctgtcacatctgtgcctggattgcttaaatattgtttgtgatggggaggttttaatctggtgatgcagagggaagcagggctgtgggggcacgtttaattggctcccagcagcgtggggggtgcttctatggtgtgtggggttttttgttgcctccctctagaagtgttaccgttttcacgtcctattaatgtcctctggttgttaaattacagcagcacattacagtgcactgggttccctcctggagtgaatacaaacggagggcatctacttgtatttttagaagttttgggagaatttagtgatttgtggctttgatcaatcctgttgactggtgtatgtctgcgcaaacctgtttcaaataaatcttttgttaaagtaa

SEQ ID NO: 2706 - DNA, 4204 bp, Homo sapiens
atgagatgtcccgggccacgtctgttggagaccagctggaggcacccgcccgcaccatttacctcaaccaaccgccacctctatgacttcactggaaacttgaacttagatgggaaaagccttgttgcccttgggcctgaccagatcttattaagaggtacacagcttagaaatactcagtgggtctttggcatagttgtttatactggacacgacaccaaactcatgcagaattcaaccaaagcgcctctcaagagatcaaatgttgagaaggtgactaacgtgcagatcctggtgttgtttggcatcctcttggtcatggccttggtgagctcggcgggggccctgtactggaacaggtctcatggtgaaaagaactggtacatcaagaagatggacaccacctcagataattttggatacaacctactgacgttcatcatcttatacaacaatcttattcccatcagtctgttggtgactcttgaggttgtgaagtatactcaagcccttttcataaactgggacacagatatgtattatataggaaatgacactcctgccatggccaggacatcaaaccttaatgaagagcttgggcaggtgaaatatctcttttctgacaagactggaacgcttacatgcaatatcatgaactttaagaagtgcagcattgccggagtaacctatggtcacttcccagaattggcaagagagccgtcttcagatgacttctgtcggatgcctcctccctgtagtgattcctgtgactttgatgaccccaggctgttgaagaacattgaggatcgccatcccacagccccttgcattcaggagttcctcacccttctggccgtgtgccacacggttgttcctgagaaggatggagataacatcatctaccaggcctcttccccagatgaagctgctttggtgaaaggagctaaaaagctgggctttgtcttcacagccagaacaccattctcagtcatcatagaagcgatgggacaggaacaaacattcggaatccttaatgtcctggaattttctagtgacagaaaaagaatgtctgtaattgttcgaactccttcaggacgacttcggctttactgtaaaggggctgataatgtgatttttgagagactttcaaaagactcaaaatatatggaggaaacattatgccatctggaatactttgccacggaaggcttgcggactctctgtgtggcttatgctgatctctctgagaatgagtatgaggagtggctgaaagtctatcaggaagccagcaccatattgaaggacagagctcaacggttggaagagtgttacgagatcattgagaagaatttgctgctacttggagccacagccatagaagatcgccttcaagcaggagttccagaaaccatcgcaacactgttgaaggcagaaattaaaatatgggtgttgacaggagacaaacaagaaactgcgattaatatagggtattcctgccgattggtatcgcagaatatggcccttatcctattgaaggaggactctttggatgccacaagggcagccattactcagcactgcactgaccttgggaatttgctgggcaaggaaaatgacgtggccctgatcatcgatggccacaccctgaagtacgcgctctccttcgaagtccggaggagtttcctggatttggcactctcgtgcaaagcggtcatatgctgcagagtgtctcctctgcagaagtctgagatagtggatgtggtgaagaagcgggtgaaggccatcaccctcgccatcggagacggcgccaacgatgtcgggatgatccagacagcccacgtgggtgtgggaatcagtgggaatgaaggcatgcaggccaccaacaactcggattacgccatcgcacagttttcctacttagagaagcttctgttggttcatggagcctggagctacaaccgggtgaccaagtgcatcttgtactgcttctataagaacgtggtcctgtatattattgagctttggttcgcctttgttaatggattttctgggcagattttatttgaacgttggtgcatcggcctgtacaatgtgattttcaccgctttgccgcccttcactctgggaatctttgagaggtcttgcactcaggagagcatgctcaggtttccccagctctacaaaatcacccagaatggcgaaggcttcaacacaaaggttttctggggtcactgcatcaacgccttggtccactccctcatcctcttctggtttcccatgaaagctctggagcatgatactgtgttgacaagtggtcatgctaccgactatttatttgttggaaatattgtttacacatatgttgttgttactgtttgtctgaaagctggtttggagaccacagcttggactaaattcagtcatctggctgtctggggaagcatgctgacctggctggtgttttttggcatctactcgaccatctggcccaccattcccattgctccagatatgagaggacaggcaactatggtcctgagctccgcacacttctggttgggattatttctggttcctactgcctgtttgattgaagatgtggcatggagagcagccaagcacacctgcaaaaagacattgctggaggaggtgcaggagctggaaaccaagtctcgagtcctgggaaaagcggtgctgcgggatagcaatggaaagaggctgaacgagcgcgaccgcctgatcaagaggctgggccggaagacgcccccgacgctgttccggggcagctccctgcagcagggcgtcccgcatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcattcaactgtgctctgtgaggtgtgaaattaaaaacattatgtttcaccaatatttaaacatcagtactagttgtcctgggagaaagggaaaggagttttatgttgcgtgagaggcccatcctgtgtaattggagcagggcacacttgcttcctgttgagttaactcagaggttaagtccaacgggccacatgcagacttcactgtaggcaggttgctctcctgctttgattcctgttttgtgtgtaaaattggcataaacttcttgattgcagtgaaatcacaaaattctctatcggggtggtcaacctgagaacatttatttgaacctcttagccacatttccagcagggcaaaccaactgatgccctggaagagtcttccgcaccctctccaggtgcactcggcccagtcctgccgccgtgtccaggcgcccctcacccccacacctgctgcatggctggccacaccactcagtgcatggcggccgatgggcagccaacccaaacccgcgcctttccttgttccactgcagactcagatacagatgcgaaaaattccttcttccaccgcccttctcgttctgtaaagaaagaaaagaaacatagcctttctgcatatattctaaacgtctctctgcctctgtctgacatggggccaccccacaggtcagagtggtggtagaaccccttcaggactcccagccgtggtcaggctctgaatactcccttcccaacatccagactgctgggcctttggcatccacttacattagaacccacgtttgtttcagagcacattttggactttcactgttgggaaatgaatgaatttataacatgcctgcacagcgaaggaacacacctgtcgctcttagctctagagtcagaggatgagtaaacccagatgcaagagtataggacattgagtggggagaacaagacgaccacagaagtcctcagaaggagaaggaaggacacggagacactgagaggaggacacagaggaatcgccaccagatctttgcagtagaaactctgaaata

SEQ ID NO: 2707 - DNA, 5095 bp, Homo sapiens
gtttcaggaccgttggcaccgggctaacggttccaccacgtccgccgccctggacgcccgcggcctgcccccccctgcctctcctgcgccgatacacttcgagtggattctggccatttgagcattctctccaactctccaatccccagtctgcccccacgggggtctcccccacctctcccccgtcccacagcctaaacccctcttcgccctgaacctcccttttcctcatgcggtgaatgggcactggccccgctcagactcccaggagcaccagagctggccctgagccaagccctgccccaccaggacctggggacacgggtgactcagacgtgactcaggaaggctcaggtcctgctggcatccgcggaggtgagacggtgatcagagctgggatgggagactccccaggcagaggggcacctgagaggaggcacaaggcccagcctggccgggctaggaagtatgaatggagaccagaaggccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagagcttcaagcagaagaaatggcaggatctgtgcgtgggggatgtggtctgtctccgcaaggacaacatcgtcccagccgacatgctcttgctggccagcacggagcccagcagcctgtgctatgtggagacggtggacattgacggggagaccaacttgaagttcagacaggccctgatggtcacccacaaagaactggccactataaagaagatggcgtcctttcaaggcacagtgacgtgtgaggcgcctaacagtcggatgcaccacttcgtggggtgcctggaatggaatgacaagaaatactccctggacattggcaacctcctcctccgaggctgcaggattcgcaacacagacacctgctatggactggtcatttatgctggttttgacacaaaaattatgaagaactgtggcaagatccatttgaagagaaccaagctggacctcctgatgaacaagctggtggttgtgatcttcatctccgtggtgcttgtctgcctggtgttggccttcggcttcggtttctcagtcaaagaattcaaagaccaccactactacctctcgggggtgcatgggagcagcgtggccgcagagtccttcttcgtcttctggagcttcctcatcctgctcagcgtcaccatcccgatgtccatgttcatcctgtccgagttcatctacctggggaacagcgtcttcatcgactgggacgtgcagatgtactacaagccgcaggacgtgcctgccaaggcccgcagcaccagcctcaacgaccacctgggccaggtggaatacatcttctcggacaagacgggcacgctcacgcagaacatcttgaccttcaacaagtgctgcatcagcggccgcgtctatgggccggattcagaggccacgacccgacctaaggagaacccctacctctggaacaagttcgccgacgggaagctgctcttccacaatgcggccctgctgcacctcgtgcggaccaacggggacgaggccgtgcgggagttctggcgcctgctggccatctgccacacggtgatggtgcgggagagcccccgtgagcgcccagaccagctgttgtaccaggcggcctcccccgacgagggggcgctggtcaccgcagcccggaacttcggctacgtgttcctgtcccgcacccaggacaccgtcacgatcatggagctgggggaggaacgggtctaccaggtcctggccataatggacttcaacagcacgcgcaaacggatgtcggtgctggttcgaaagccagagggcgccatctgcctgtacaccaagggcgccgacacggtcatcttcgaacgcttgcacaggaggggggcaatggaatttgccacagaggaggccttggctgcctttgcccaggagaccctgcggacactgtgcctggcctacagggaggtggctgaggacatttacgaggactggcagcagcgccaccaggaggccagcctcctgctgcagaaccgggcacaggccctgcaacagctgctgggagccacagccatcgaggacagactccaggacggtgtccctgaaaccatcaaatgtctcaagaagagcaacatcaaaatatgggtgctcaccggggacaagcaggaaacggctgtgaacatcggcttcgcctgcgagctgctgtcagagaatatgctcattctggaggagaaggagattagccgcatcctggagacctactgggaaaacagtaacaaccttctaaccagggagtccctgtcgcaggtcaagctggccttggtcattaacggagacttcctggacaaactgctggtgtccctgcggaaggagccgcgcgccctggcgcagaacgtgaacatggacgaggcgtggcaggagctcggccagtccaggagggatttcctctacgccaggcgcctgtccctgctgtgccggaggttcgggctcccgctggctgcaccgccagcccaggactccagagcccgccgtagctccgaggtgctgcaggagcgcgccttcgtggacctggcgtccaagtgccaggcggtcatctgctgccgcgtgacgcccaagcagaaggccctgatcgtggccctggtcaagaagtaccaccaggtggtgaccctggccatcggggacggtgccaacgacatcaacatgatcaagaccgcggacgtgggcgtggggctggcgggccaggagggcatgcaggcagttcagaacagcgacttcgtgctcggccagttctgcttcctgcagcgcctcctgctggtgcacggccgctggtcctacgtgcggatctgcaagttcctgcgctacttcttctacaagagcatggccagcatgatggtgcaggtctggtttgcctgctacaacggcttcaccggccagcccctgtatgaaggatggttcctggctcttttcaacctcctgtacagcaccctgccagttctctacattgggctctttgagcaggacgtgagcgcagagcagagcctggagaagccggagctgtacgtggtggggcagaaggacgagctcttcaactactgggtcttcgtccaagccatcgcccatggtgtgaccacctctctggtcaacttcttcatgacactgtggatcagccgcgacacggcgggacccgccagcttcagcgaccaccagtcctttgcggtcgtggtggccctgtcttgcctgctgtccatcaccatggaggtcattcttatcatcaagtactggaccgccctgtgcgtggcgaccatcctcctcagccttggtttctacgccatcatgactaccaccacccagagcttctggctcttcagagtatcccccacgaccttcccgtttctgtatgccgacctcagcgtgatgtcctctccctccatcctgctggtggtcctgctgagtgtgtccataaacaccttccctgtcctggccctccgagtcatcttcccagccctcaaggagctacgtgccaaggaggagaaggtggaggagggccccagcgaggagattttcaccatggagcccttgcctcatgtacaccgggagtctcgtgcccgccgttccagctatgctttctcccaccgtgagggatatgcaaacctcatcactcagggcacaattctgcggaggggaccaggggtcagcagtgacatagcatctgaatccctagacccatctgatgaagaggcagcttcgagcccaaaagagtcacagtgacacctcaggaagatgtccttcctggggaagaagaagcaccagccacaggggcaggtgtcctcccaggaagtacagctcccccctacacctagctcatcattttctatggatagacaatccgctcttcatccagaaaaccaacctgccctccccaaatatgtgctcaccagcagcaacaggctatctgagtctttccaagagcaattgccaagggcacaggagaggtcattgtcacccaagcagaggccaccttctcctgagaagttgctgttgaccaaggagaggtcacattcttttcaggagaaatcactgttgcacagagaaagccagctgtcgtcatttgagagccagccacagcctctggggagccagtcatttctttcaggccagctgacgttggagagccagccagactcctcggaggagaagtcagcatttttgaagccctccacaccgttccggaagagctggcaaaaggagcctcacacccccaaggaggggacggtgccacttccagacaagacccacaaatctcaggtggagactctgccaccaagtctggaagaatcgtccacgtccacgagcgagcagcctatggaggtggagctgtggcccgcggagaagcagtcatcatcatccatggagtggctgctggtgcccggggaggagcagctatccttgcccccagaggagcagtcattgccctctgcggaggggaccagggttcagcagtgacgtagcatctgaatccctagacccatctgatgaagaggcatcttcgagcccaaaggagtcacgctggcatatcaggaagatgtccttcctgggaagaagaagctccagccagttctgctgcaagtcaaccagcatgcagggggccttcctctaaagacaaggactccacatgcttttctttttctaataaaccagggtccatctgaccccagcgctaa

SEQ ID NO: 2708 - DNA, 2758 bp, Homo sapiens
gtttcaggaccgttggcaccgggctaacggttccaccacgtccgccgccctggacgcccgcggcctgcccccccctgcctctcctgcgccggacctggggacacgggtgactcagacgtgactcaggaaggctcaggtcctgctggcatccgcggaggtgagacggtgatcagagctgggatgggagactccccaggcagaggggcacctgagaggaggcacaaggcccagcctggccgggctaggaagtatgaatggagaccagaaggccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagagcttcaagcagaagaaatggcaggatctgtgcgtgggggatgtggtctgtctccgcaaggacaacatcgtcccagccgacatgctcttgctggccagcacggagcccagcagcctgtgctatgtggagacggtggacattgacggggagaccaacttgaagttcagacaggccctgatggtcacccacaaagaactggccactataaagaagatggcgtcctttcaaggcacagtgacgtgtgaggcgcctaacagtcggatgcaccacttcgtggggtgcctggaatggaatgacaagaaatactccctggacattggcaacctcctcctccgaggctgcaggattcgcaacacagacacctgctatggactggtcatttatgctggttttgacacaaaaattatgaagaactgtggcaagatccatttgaagagaaccaagctggacctcctgatgaacaagctggtggttgtgatcttcatctccgtggtgcttgtctgcctggtgttggccttcggcttcggtttctcagtcaaagaattcaaagaccaccactactacctctcgggggtgcatgggagcagcgtggccgcagagtccttcttcgtcttctggagcttcctcatcctgctcagcgtcaccatcccgatgtccatgttcatcctgtccgagttcatctacctggggaacagcgtcttcatcgactgggacgtgcagatgtactacaagccgcaggacgtgcctgccaaggcccgcagcaccagcctcaacgaccacctgggccaggtggaatacatcttctcggacaagacgggcacgctcacgcagaacatcttgaccttcaacaagtgctgcatcagcggccgcgtctatggtgcggccccgacacctgagctcccagctgggtcctcgatcttcaaggggctcagggtgcctgagaaccagagccacgtctggccccatgcccagcacctccgcccgaatctgaaccagggaaccgtagccagatggcctggtttcctttggagggggccaggaaaattttttttttttttgaggcagagtctcactctgtctacccaggcaggaatgcagtggtgcaatcttggctcactgcaatctccacctcccaggttcaagcgattctcctggctcagcctcccgagtagctgggattacaggcacctgccaccacacctaatttttttgtatttttagcagagatggggtttcaccatgttggccatgctggtctcgaactcctggcctccggcgatccacctgcctcggcctcccaaagtgctgggattacaggcgtgagccaccacgcccggccgactttttttttttttttctctctgagacggagttttgctctcgttgcccaggctggagtgcagtggtgcgatctctgctcactgaaacctccgcctcctgggttgattctcccgcctcagcctcccaagtagctgggattacagttgcgtgccaccccgcctggctaatttttgtattttttttttcagtagagatggggtttcaccctgtttcccaggctggtctcgaactcctgacttcaggtgatctgcctgcctcagcctccaaaatattggcattgcaggcatgagccaccacacctagccaaacttttaaacagtgtgtatttatttattttttgagatggggtcttgctctgccgcccaggctggaatgcagtggtgcaatcatagcttattgcagcctcgaattcctgggctcaagcaatcctcccacttcagcttcccaagtagccgggactacaggagagtgccaccttacccagcttatttttgtattttttgtcaagacagggaatccctatgttgcccaggctggtcttgaactcctgggcttaagcgatccgcctgcctccgcttttcaaagcactggaattacagatgtgagccaccacacccggccactgctcttcttttgactttcacaagcctttatttgtggatgctgaaattcgaattgctgagtatttctcagatcacaaaataaaatagttttgtttgtt

SEQ ID NO: 2709 - DNA, 4014 bp, Homo sapiens
gcctctcctgcgccggtgagcggcgggtgctcccactgctgtgcgtccccgggagcccgcgcaccctctctgggctccacccaggctgagagctggggtcgtggcggcgggggtggagagcgcgcccctagaggacctggggacacgggtgactcagacgtgactcaggaaggctcaggtcctgctggcatccgcggaggtgagacggtgatcagagctgggatgggagactccccaggcagaggggcacctgagaggaggcacaaggcccagcctggccgggctaggaagtatgaatggagaccagaaggccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagagcttcaagcagaagaaatggcaggatctgtgcgtgggggatgtggtctgtctccgcaaggacaacatcgtcccagccgacatgctcttgctggccagcacggagcccagcagcctgtgctatgtggagacggtggacattgacggggagaccaacttgaagttcagacaggccctgatggtcacccacaaagaactggccactataaagaagatggcgtcctttcaaggcacagtgacgtgtgaggcgcctaacagtcggatgcaccacttcgtggggtgcctggaatggaatgacaagaaatactccctggacattggcaacctcctcctccgaggctgcaggattcgcaacacagacacctgctatggactggtcatttatgctgatggatacatgtttgtaggttttgacacaaaaattatgaagaactgtggcaagatccatttgaagagaaccaagctggacctcctgatgaacaagctggtggttgtgatcttcatctccgtggtgcttgtctgcctggtgttggccttcggcttcggtttctcagtcaaagaattcaaagaccaccactactacctctcgggggtgcatgggagcagcgtggccgcagagtccttcttcgtcttctggagcttcctcatcctgctcagcgtcaccatcccgatgtccatgttcatcctgtccgagttcatctacctggggaacagcgtcttcatcgactgggacgtgcagatgtactacaagccgcaggacgtgcctgccaaggcccgcagcaccagcctcaacgaccacctgggccaggtggaatacatcttctcggacaagacgggcacgctcacgcagaacatcttgaccttcaacaagtgctgcatcagcggccgcgtctatgggccggattcagaggccacgacccgacctaaggagaacccctacctctggaacaagttcgccgacgggaagctgctcttccacaatgcggccctgctgcacctcgtgcggaccaacggggacgaggccgtgcgggagttctggcgcctgctggccatctgccacacggtgatggtgcgggagagcccccgtgagcgcccagaccagctgttgtaccaggcggcctcccccgacgagggggcgctggtcaccgcagcccggaacttcggctacgtgttcctgtcccgcacccaggacaccgtcacgatcatggagctgggggaggaacgggtctaccaggtcctggccataatggacttcaacagcacgcgcaaacggatgtcggtgctggttcgaaagccagagggcgccatctgcctgtacaccaagggcgccgacacggtcatcttcgaacgcttgcacaggaggggggcaatggaatttgccacagaggaggccttggctgcctttgcccaggagaccctgcggacactgtgcctggcctacagggaggtggctgaggacatttacgaggactggcagcagcgccaccaggaggccagcctcctgctgcagaaccgggcacaggccctgcaacaggtgtacaacgagatggagcaggacctcaggctgctgggagccacagccatcgaggacagactccaggacggtgtccctgaaaccatcaaatgtctcaagaagagcaacatcaaaatatgggtgctcaccggggacaagcaggaaacggctgtgaacatcggcttcgcctgcgagctgctgtcagagaatatgctcattctggaggagaaggagattagccgcatcctggagacctactgggaaaacagtaacaaccttctaaccagggagtccctgtcgcaggtcaagctggccttggtcattaacggagacttcctggacaaactgctggtgtccctgcggaaggagccgcgcgccctggcgcagaacgtgaacatggacgaggcgtggcaggagctcggccagtccaggagggatttcctctacgccaggcgcctgtccctgctgtgccggaggttcgggctcccgctggctgcaccgccagcccaggactccagagcccgccgtagctccgaggtgctgcaggagcgcgccttcgtggacctggcgtccaagtgccaggcggtcatctgctgccgcgtgacgcccaagcagaaggccctgatcgtggccctggtcaagaagtaccaccaggtggtgaccctggccatcggggacggtgccaacgacatcaacatgatcaagaccgcggacgtgggcgtggggctggcgggccaggagggcatgcaggcagttcagaacagcgacttcgtgctcggccagttctgcttcctgcagcgcctcctgctggtgcacggccgctggtcctacgtgcggatctgcaagttcctgcgctacttcttctacaagagcatggccagcatgatggtgcaggtctggtttgcctgctacaacggcttcaccggccagcccctgtatgaaggatggttcctggctcttttcaacctcctgtacagcaccctgccagttctctacattgggctctttgagcaggacgtgagcgcagagcagagcctggagaagccggagctgtacgtggtggggcagaaggacgagctcttcaactactgggtcttcgtccaagccatcgcccatggtgtgaccacctctctggtcaacttcttcatgacactgtggatcagccgcgacacggcgggacccgccagcttcagcgaccaccagtcctttgcggtcgtggtggccctgtcttgcctgctgtccatcaccatggaggtcattcttatcatcaagtactggaccgccctgtgcgtggcgaccatcctcctcagccttggtttctacgccatcatgactaccaccacccagagcttctggctcttcagagtatcccccacgaccttcccgtttctgtatgccgacctcagcgtgatgtcctctccctccatcctgctggtggtcctgctgagtgtgtccataaacaccttccctgtcctggccctccgagtcatcttcccagccctcaaggagctacgtgccaaggaggagaaggtggaggagggccccagcgaggagattttcaccatggagcccttgcctcatgtacaccgggagtctcgtgcccgccgttccagctatgctttctcccaccgtgagggatatgcaaacctcatcactcagggcacaattctgcggaggggaccaggggtcagcagtgacatagcatctgaatccctagacccatctgatgaagaggcagcttcgagcccaaaagagtcacagtga

SEQ ID NO: 2710 - DNA, 5118 bp, Homo sapiens
aggaccgttggcaccgggctaacggttccaccacgtccgccgccctggacgcccgcggcctgcccccccctgcctctcctgcgccgatacacttcgagtggattctggccatttgagcattctctccaactctccaatccccagtctgcccccacgggggtctcccccacctctcccccgtcccacagcctaaacccctcttcgccctgaacctcccttttcctcatgcggtgaatgggcactggccccgctcagactcccaggagcaccagagctggccctgagccaagccctgccccaccaggacctggggacacgggtgactcagacgtgactcaggaaggctcaggtcctgctggcatccgcggaggtgagacggtgatcagagctgggatgggagactccccaggcagaggggcacctgagaggaggcacaaggcccagcctggccgggctaggaagtatgaatggagaccagaaggccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagagcttcaagcagaagaaatggcaggatctgtgcgtgggggatgtggtctgtctccgcaaggacaacatcgtcccagccgacatgctcttgctggccagcacggagcccagcagcctgtgctatgtggagacggtggacattgacggggagaccaacttgaagttcagacaggccctgatggtcacccacaaagaactggccactataaagaagatggcgtcctttcaaggcacagtgacgtgtgaggcgcctaacagtcggatgcaccacttcgtggggtgcctggaatggaatgacaagaaatactccctggacattggcaacctcctcctccgaggctgcaggattcgcaacacagacacctgctatggactggtcatttatgctggttttgacacaaaaattatgaagaactgtggcaagatccatttgaagagaaccaagctggacctcctgatgaacaagctggtggttgtgatcttcatctccgtggtgcttgtctgcctggtgttggccttcggcttcggtttctcagtcaaagaattcaaagaccaccactactacctctcgggggtgcatgggagcagcgtggccgcagagtccttcttcgtcttctggagcttcctcatcctgctcagcgtcaccatcccgatgtccatgttcatcctgtccgagttcatctacctggggaacagcgtcttcatcgactgggacgtgcagatgtactacaagccgcaggacgtgcctgccaaggcccgcagcaccagcctcaacgaccacctgggccaggtggaatacatcttctcggacaagacgggcacgctcacgcagaacatcttgaccttcaacaagtgctgcatcagcggccgcgtctatgggccggattcagaggccacgacccgacctaaggagaacccctacctctggaacaagttcgccgacgggaagctgctcttccacaatgcggccctgctgcacctcgtgcggaccaacggggacgaggccgtgcgggagttctggcgcctgctggccatctgccacacggtgatggtgcgggagagcccccgtgagcgcccagaccagctgttgtaccaggcggcctcccccgacgagggggcgctggtcaccgcagcccggaacttcggctacgtgttcctgtcccgcacccaggacaccgtcacgatcatggagctgggggaggaacgggtctaccaggtcctggccataatggacttcaacagcacgcgcaaacggatgtcggtgctggttcgaaagccagagggcgccatctgcctgtacaccaagggcgccgacacggtcatcttcgaacgcttgcacaggaggggggcaatggaatttgccacagaggaggccttggctgcctttgcccaggagaccctgcggacactgtgcctggcctacagggaggtggctgaggacatttacgaggactggcagcagcgccaccaggaggccagcctcctgctgcagaaccgggcacaggccctgcaacaggtgtacaacgagatggagcaggacctcaggctgctgggagccacagccatcgaggacagactccaggacggtgtccctgaaaccatcaaatgtctcaagaagagcaacatcaaaatatgggtgctcaccggggacaagcaggaaacggctgtgaacatcggcttcgcctgcgagctgctgtcagagaatatgctcattctggaggagaaggagattagccgcatcctggagacctactgggaaaacagtaacaaccttctaaccagggagtccctgtcgcaggtcaagctggccttggtcattaacggagacttcctggacaaactgctggtgtccctgcggaaggagccgcgcgccctggcgcagaacgtgaacatggacgaggcgtggcaggagctcggccagtccaggagggatttcctctacgccaggcgcctgtccctgctgtgccggaggttcgggctcccgctggctgcaccgccagcccaggactccagagcccgccgtagctccgaggtgctgcaggagcgcgccttcgtggacctggcgtccaagtgccaggcggtcatctgctgccgcgtgacgcccaagcagaaggccctgatcgtggccctggtcaagaagtaccaccaggtggtgaccctggccatcggggacggtgccaacgacatcaacatgatcaagaccgcggacgtgggcgtggggctggcgggccaggagggcatgcaggcagttcagaacagcgacttcgtgctcggccagttctgcttcctgcagcgcctcctgctggtgcacggccgctggtcctacgtgcggatctgcaagttcctgcgctacttcttctacaagagcatggccagcatgatggtgcaggtctggtttgcctgctacaacggcttcaccggccagcccctgtatgaaggatggttcctggctcttttcaacctcctgtacagcaccctgccagttctctacattgggctctttgagcaggacgtgagcgcagagcagagcctggagaagccggagctgtacgtggtggggcagaaggacgagctcttcaactactgggtcttcgtccaagccatcgcccatggtgtgaccacctctctggtcaacttcttcatgacactgtggatcagccgcgacacggcgggacccgccagcttcagcgaccaccagtcctttgcggtcgtggtggccctgtcttgcctgctgtccatcaccatggaggtcattcttatcatcaagtactggaccgccctgtgcgtggcgaccatcctcctcagccttggtttctacgccatcatgactaccaccacccagagcttctggctcttcagagtatcccccacgaccttcccgtttctgtatgccgacctcagcgtgatgtcctctccctccatcctgctggtggtcctgctgagtgtgtccataaacaccttccctgtcctggccctccgagtcatcttcccagccctcaaggagctacgtgccaaggaggagaaggtggaggagggccccagcgaggagattttcaccatggagcccttgcctcatgtacaccgggagtctcgtgcccgccgttccagctatgctttctcccaccgtgagggatatgcaaacctcatcactcagggcacaattctgcggaggggaccaggggtcagcagtgacatagcatctgaatccctagacccatctgatgaagaggcagcttcgagcccaaaagagtcacagtgacacctcaggaagatgtccttcctggggaagaagaagcaccagccacaggggcaggtgtcctcccaggaagtacagctcccccctacacctagctcatcattttctatggatagacaatccgctcttcatccagaaaaccaacctgccctccccaaatatgtgctcaccagcagcaacaggctatctgagtctttccaagagcaattgccaagggcacaggagaggtcattgtcacccaagcagaggccaccttctcctgagaagttgctgttgaccaaggagaggtcacattcttttcaggagaaatcactgttgcacagagaaagccagctgtcgtcatttgagagccagccacagcctctggggagccagtcatttctttcaggccagctgacgttggagagccagccagactcctcggaggagaagtcagcatttttgaagccctccacaccgttccggaagagctggcaaaaggagcctcacacccccaaggaggggacggtgccacttccagacaagacccacaaatctcaggtggagactctgccaccaagtctggaagaatcgtccacgtccacgagcgagcagcctatggaggtggagctgtggcccgcggagaagcagtcatcatcatccatggagtggctgctggtgcccggggaggagcagctatccttgcccccagaggagcagtcattgccctctgcggaggggaccagggttcagcagtgacgtagcatctgaatccctagacccatctgatgaagaggcatcttcgagcccaaaggagtcacgctggcatatcaggaagatgtccttcctgggaagaagaagctccagccagttctgctgcaagtcaaccagcatgcagggggccttcctctaaagacaaggactccacatgcttttctttttctaataaaccagggtccatctgaccccagcgct

SEQ ID NO: 2711 - DNA, 3456 bp, Homo sapiens
ggggtggccggctgctcaagtgggacgggggtcagagctttgtggagggaagaaaaacctggagggggcaggagagtaaaaagaagaaacccaggcagacaggcagttggacacactgaggaagaccccccacgagtgggaaccccctggaaggaacacaccggccccggcccccaggaagggagcacaatggaggccgctcatgctaaaaccacggaggaatgtttggcctattttggggtgagtgagaccacgggcctcaccccggaccaagttaagcggaatctggagaaatacggcctcaatgagctccctgctgaggaagggaagaccctgtgggagctggtgatagagcagtttgaagacctcctggtgcggattctcctcctggccgcatgcatttccttcgtgctggcctggtttgaggaaggtgaagagaccatcactgcctttgttgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggctcgggacatcgtccctggggacatcgtggaggtggctgtgggggacaaagtccctgcagacatccgaatcctcgccatcaaatccaccacgctgcgggttgaccagtccatcctgacaggcgagtctgtatctgtcatcaaacacacggagcccgttcctgacccccgagctgtcaaccaggacaagaagaacatgcttttctcgggcaccaacattgcagccggcaaggccttgggcatcgtggccaccactggtgtgggcaccgagattgggaagatccgagaccaaatggctgccacagaacaggacaagacccccttgcagcagaagctggatgagtttggggagcagctctccaaggtcatctccctcatctgtgtggctgtctggcttatcaacattggccacttcaacgaccccgtccatgggggctcctggttccgcggggccatctactactttaagattgccgtggccttggctgtggctgccatccccgaaggtcttcctgcagtcatcaccacctgcctggccctgggtacccgtcggatggcaaagaagaatgccattgtaagaagcttgccctccgtagagaccctgggctgcacctctgtcatctgttccgacaagacaggcaccctcaccaccaaccagatgtctgtctgcaagatgtttatcattgacaaggtggatggggacatctgcctcctgaatgagttctccatcaccggctccacttacgctccagagggagaggtcttgaagaatgataagccagtccggccagggcagtatgacgggctggtggagctggccaccatctgtgccctctgcaatgactcctccttggacttcaacgaggccaaaggtgtctatgagaaggtcggcgaggccaccgagacagcactcaccaccctggtggagaagatgaatgtgttcaacacggatgtgagaagcctctcgaaggtggagagagccaacgcctgcaactcggtgatccgccagctaatgaagaaggaattcaccctggagttctcccgagacagaaagtccatgtctgtctattgctccccagccaaatcttcccgggctgctgtgggcaacaagatgtttgtcaagggtgcccctgagggcgtcatcgaccgctgtaactatgtgcgagttggcaccacccgggtgccactgacggggccggtgaaggaaaagatcatggcggtgatcaaggagtggggcactggccgggacaccctgcgctgcttggccctggccacccgggacacccccccgaagcgagaggaaatggtcctggatgactctgccaggttcctggagtatgagacggacctgacattcgtgggtgtagtgggcatgctggaccctccgcgcaaggaggtcacgggctccatccagctgtgccgtgacgccgggatccgggtgatcatgatcactggggacaacaagggcacagccattgccatctgccggcgaattggcatctttggggagaacgaggaggtggccgatcgcgcctacacgggccgagagttcgacgacctgcccctggctgaacagcgggaagcctgccgacgtgcctgctgcttcgcccgtgtggagccctcgcacaagtccaagattgtggagtacctgcagtcctacgatgagatcacagccatgacaggtgatggcgtcaatgacgcccctgccctgaagaaggctgagattggcattgccatgggatctggcactgccgtggccaagactgcctctgagatggtgctggctgacgacaacttctccaccatcgtagctgctgtggaggagggccgcgccatctacaacaacatgaagcagttcatccgctacctcatttcctccaacgtgggcgaggtggtctgtatcttcctgaccgctgccctggggctgcctgaggccctgatcccggtgcagctgctatgggtgaacttggtgaccgacgggctcccagccacagccctgggcttcaacccaccagacctggacatcatggaccgccccccccggagccccaaggagcccctcatcagtggctggctcttcttccgctacatggcaatcgggggctatgtgggtgcagccaccgtgggagcagctgcctggtggttcctgtacgctgaggatgggcctcatgtcaactacagccagctgactcacttcatgcagtgcaccgaggacaacacccactttgagggcatagactgtgaggtcttcgaggcccccgagcccatgaccatggccctgtccgtgctggtgaccatcgagatgtgcaatgcactgaacagcctgtccgagaaccagtccctgctgcggatgccaccctgggtgaacatctggctgctgggctccatctgcctctccatgtccctgcacttcctcatcctctatgttgaccccctgccgatgatcttcaagctccgggccctggacctcacccagtggctcatggtcctcaagatctcactgccagtcattgggctcgacgaaatcctcaagttcgttgctcggaactacctagaggatccagaagatgaaagaaggaagtgagcatccttttgctctgtcctccccaccccgatagtgacacatcttcaggcagagctgtggcacagacccccgtcctgtcccccacacccgtgtcatgtgtctgtttataaacatgtccccttccctttccttccccctcggccacccgcctccctctcaaccttgtaaattccccttcccaaccccgaggggcttgcagggacaaggcgaccgactgcgctgagctgcttatttattgaaaataaacgacggaaaagtctg

SEQ ID NO: 2712 - DNA, 2608 bp, Homo sapiens
ggccggctgctcaagtgggacgggggtcagagctttgtggagggaagaaaaacctggagggggcaggagagtaaaaagaagaaacccaggcagacaggcagttggacacactgaggaagaccccccacgagtgggaaccccctggaaggaacacaccggccccggcccccaggaagggagcacaatggaggccgctcatgctaaaaccacggaggaatgtttggcctattttggggtgagtgagaccacgggcctcaccccggaccaagttaagcggaatctggagaaatacggcctcaatgagctccctgctgaggaagggaagaccctgtgggagctggtgatagagcagtttgaagacctcctggtgcggattctcctcctggccgcatgcatttccttcgtgctggcctggtttgaggaaggtgaagagaccatcactgcctttgttgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggctcgggacatcgtccctggggacatcgtggaggtggctgtgggggacaaagtccctgcagacatccgaatcctcgccatcaaatccaccacgctgcgggttgaccagtccatcctgacaggcgagtctgtatctgtcatcaaacacacggagcccgttcctgacccccgagctgtcaaccaggacaagaagaacatgcttttctcgggcaccaacattgcagccggcaaggccttgggcatcgtggccaccactggtgtgggcaccgagattgggaagatccgagaccaaatggctgccacagaacaggacaagacccccttgcagcagaagctggatgagtttggggagcagctctccaaggtcatctccctcatctgtgtggctgtctggcttatcaacattggccacttcaacgaccccgtccatgggggctcctggttccgcggggccatctactactttaagattgccgtggccttggctgtggctgccatccccgaaggtcttcctgcagtcatcaccacctgcctggccctgggtacccgtcggatggcaaagaagaatgccattgtaagaagcttgccctccgtagagaccctgggctgcacctctgtcatctgttccgacaagacaggcaccctcaccaccaaccagatgtctgtctgcaagatgtttatcattgacaaggtggatggggacatctgcctcctgaatgagttctccatcaccggctccacttacgctccagagggagaggtcttgaagaatgataagccagtccggccagggcagtatgacgggctggtggagctggccaccatctgtgccctctgcaatgactcctccttggacttcaacgaggccaaaggtgtctatgagaaggtcggcgaggccaccgagacagcactcaccaccctggtggagaagatgaatgtgttcaacacggatgtgagaagcctctcgaaggtggagagagccaacgcctgcaactcggtgatccgccagctaatgaagaaggaattcaccctggagttctcccgagacagaaagtccatgtctgtctattgctccccagccaaatcttcccgggctgctgtgggcaacaagatgtttgtcaagggtgcccctgagggcgtcatcgaccgctgtaactatgtgcgagttggcaccacccgggtgccactgacggggccggtgaaggaaaagatcatggcggtgatcaaggagtggggcactggccgggacaccctgcgctgcttggccctggccacccgggacacccccccgaagcgagaggaaatggtcctggatgactctgccaggttcctggagtatgagacggacctgacattcgtgggtgtagtgggcatgctggaccctccgcgcaaggaggtcacgggctccatccagctgtgccgtgacgccgggatccgggtgatcatgatcactggggacaacaagggcacagccattgccatctgccggcgaattggcatctttggggagaacgaggaggtggccgatcgcgcctacacgggccgagagttcgacgacctgcccctggctgaacagcgggaagcctgccgacgtgcctgctgcttcgcccgtgtggagccctcgcacaagtccaagattgtggagtacctgcagtcctacgatgagatcacagccatgacaggtgatggcgtcaatgacgcccctgccctgaagaaggctgagattggcattgccatgggatctggcactgccgtggccaagactgcctctgagatggtgctggctgacgacaacttctccaccatcgtagctgctgtggaggagggccgcgccatctacaacaacatgaagcagttcatccgctacctcatttcctccaacgtgggcgaggtggtctgtatcttcctgaccgctgccctggggctgcctgaggccctgatcccggtgcagctgctatgggtgaacttggtgaccgactgcgctgagctgcttatttattga

SEQ ID NO: 2713 - DNA, 3493 bp, Homo sapiens
ggccggctgctcaagtgggacgggggtcagagctttgtggagggaagaaaaacctggagggggcaggagagtaaaaagaagaaacccaggcagacaggcagttggacacactgaggaagaccccccacgagtgggaaccccctggaaggaacacaccggccccggcccccaggaagggagcacaatggaggccgctcatgctaaaaccacggaggaatgtttggcctattttggggtgagtgagaccacgggcctcaccccggaccaagttaagcggaatctggagaaatacggcctcaatgagctccctgctgaggaagggaagaccctgtgggagctggtgatagagcagtttgaagacctcctggtgcggattctcctcctggccgcatgcatttccttcgtgctggcctggtttgaggaaggtgaagagaccatcactgcctttgttgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggctcgggacatcgtccctggggacatcgtggaggtggctgtgggggacaaagtccctgcagacatccgaatcctcgccatcaaatccaccacgctgcgggttgaccagtccatcctgacaggcgagtctgtatctgtcatcaaacacacggagcccgttcctgacccccgagctgtcaaccaggacaagaagaacatgcttttctcgggcaccaacattgcagccggcaaggccttgggcatcgtggccaccactggtgtgggcaccgagattgggaagatccgagaccaaatggctgccacagaacaggacaagacccccttgcagcagaagctggatgagtttggggagcagctctccaaggtcatctccctcatctgtgtggctgtctggcttatcaacattggccacttcaacgaccccgtccatgggggctcctggttccgcggggccatctactactttaagattgccgtggccttggctgtggctgccatccccgaaggtcttcctgcagtcatcaccacctgcctggccctgggtacccgtcggatggcaaagaagaatgccattgtaagaagcttgccctccgtagagaccctgggctgcacctctgtcatctgttccgacaagacaggcaccctcaccaccaaccagatgtctgtctgcaagatgtttatcattgacaaggtggatggggacatctgcctcctgaatgagttctccatcaccggctccacttacgctccagagggagaggtcttgaagaatgataagccagtccggccagggcagtatgacgggctggtggagctggccaccatctgtgccctctgcaatgactcctccttggacttcaacgaggccaaaggtgtctatgagaaggtcggcgaggccaccgagacagcactcaccaccctggtggagaagatgaatgtgttcaacacggatgtgagaagcctctcgaaggtggagagagccaacgcctgcaactcggtgatccgccagctaatgaagaaggaattcaccctggagttctcccgagacagaaagtccatgtctgtctattgctccccagccaaatcttcccgggctgctgtgggcaacaagatgtttgtcaagggtgcccctgagggcgtcatcgaccgctgtaactatgtgcgagttggcaccacccgggtgccactgacggggccggtgaaggaaaagatcatggcggtgatcaaggagtggggcactggccgggacaccctgcgctgcttggccctggccacccgggacacccccccgaagcgagaggaaatggtcctggatgactctgccaggttcctggagtatgagacggacctgacattcgtgggtgtagtgggcatgctggaccctccgcgcaaggaggtcacgggctccatccagctgtgccgtgacgccgggatccgggtgatcatgatcactggggacaacaagggcacagccattgccatctgccggcgaattggcatctttggggagaacgaggaggtggccgatcgcgcctacacgggccgagagttcgacgacctgcccctggctgaacagcgggaagcctgccgacgtgcctgctgcttcgcccgtgtggagccctcgcacaagtccaagattgtggagtacctgcagtcctacgatgagatcacagccatgacaggtgatggcgtcaatgacgcccctgccctgaagaaggctgagattggcattgccatgggatctggcactgccgtggccaagactgcctctgagatggtgctggctgacgacaacttctccaccatcgtagctgctgtggaggagggccgcgccatctacaacaacatgaagcagttcatccgctacctcatttcctccaacgtgggcgaggtggtctgtatcttcctgaccgctgccctggggctgcctgaggccctgatcccggtgcagctgctatgggtgaacttggtgaccgacgggctcccagccacagccctgggcttcaacccaccagacctggacatcatggaccgccccccccggagccccaaggagcccctcatcagtggctggctcttcttccgctacatggcaatcgggggctatgtgggtgcagccaccgtgggagcagctgcctggtggttcctgtacgctgaggatgggcctcatgtcaactacagccagctgactcacttcatgcagtgcaccgaggacaacacccactttgagggcatagactgtgaggtcttcgaggcccccgagcccatgaccatggccctgtccgtgctggtgaccatcgagatgtgcaatgcactgaacagcctgtccgagaaccagtccctgctgcggatgccaccctgggtgaacatctggctgctgggctccatctgcctctccatgtccctgcacttcctcatcctctatgttgaccccctgccgatgatcttcaagctccgggccctggacctcacccagtggctcatggtcctcaagatctcactgccagtcattgggctcgacgaaatcctcaagttcgttgctcggaactacctagagggataactgttccccctcctccatctctgagcccgtgtcacagatccagaagatgaaagaaggaagtgagcatccttttgctctgtcctccccaccccgatagtgacacatcttcaggcagagctgtggcacagacccccgtcctgtcccccacacccgtgtcatgtgtctgtttataaacatgtccccttccctttccttccccctcggccacccgcctccctctcaaccttgtaaattccccttcccaaccccgaggggcttgcagggacaaggcgaccgactgcgctgagctgcttatttattgaaaataaacgacggaaaagtctg

SEQ ID NO: 2714 - DNA, 3130 bp, Homo sapiens
agcgcggcggtgtgatgatgactccaaggagcccggcgcccggtgctggcctggtttgaggaaggtgaagagaccatcactgcctttgttgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggctcgggacatcgtccctggggacatcgtggaggtggctgtgggggacaaagtccctgcagacatccgaatcctcgccatcaaatccaccacgctgcgggttgaccagtccatcctgacaggcgagtctgtatctgtcatcaaacacacggagcccgttcctgacccccgagctgtcaaccaggacaagaagaacatgcttttctcgggcaccaacattgcagccggcaaggccttgggcatcgtggccaccactggtgtgggcaccgagattgggaagatccgagaccaaatggctgccacagaacaggacaagacccccttgcagcagaagctggatgagtttggggagcagctctccaaggtcatctccctcatctgtgtggctgtctggcttatcaacattggccacttcaacgaccccgtccatgggggctcctggttccgcggggccatctactactttaagattgccgtggccttggctgtggctgccatccccgaaggtcttcctgcagtcatcaccacctgcctggccctgggtacccgtcggatggcaaagaagaatgccattgtaagaagcttgccctccgtagagaccctgggctgcacctctgtcatctgttccgacaagacaggcaccctcaccaccaaccagatgtctgtctgcaagatgtttatcattgacaaggtggatggggacatctgcctcctgaatgagttctccatcaccggctccacttacgctccagagggagaggtcttgaagaatgataagccagtccggccagggcagtatgacgggctggtggagctggccaccatctgtgccctctgcaatgactcctccttggacttcaacgaggccaaaggtgtctatgagaaggtcggcgaggccaccgagacagcactcaccaccctggtggagaagatgaatgtgttcaacacggatgtgagaagcctctcgaaggtggagagagccaacgcctgcaactcggtgatccgccagctaatgaagaaggaattcaccctggagttctcccgagacagaaagtccatgtctgtctattgctccccagccaaatcttcccgggctgctgtgggcaacaagatgtttgtcaagggtgcccctgagggcgtcatcgaccgctgtaactatgtgcgagttggcaccacccgggtgccactgacggggccggtgaaggaaaagatcatggcggtgatcaaggagtggggcactggccgggacaccctgcgctgcttggccctggccacccgggacacccccccgaagcgagaggaaatggtcctggatgactctgccaggttcctggagtatgagacggacctgacattcgtgggtgtagtgggcatgctggaccctccgcgcaaggaggtcacgggctccatccagctgtgccgtgacgccgggatccgggtgatcatgatcactggggacaacaagggcacagccattgccatctgccggcgaattggcatctttggggagaacgaggaggtggccgatcgcgcctacacgggccgagagttcgacgacctgcccctggctgaacagcgggaagcctgccgacgtgcctgctgcttcgcccgtgtggagccctcgcacaagtccaagattgtggagtacctgcagtcctacgatgagatcacagccatgacaggtgatggcgtcaatgacgcccctgccctgaagaaggctgagattggcattgccatgggatctggcactgccgtggccaagactgcctctgagatggtgctggctgacgacaacttctccaccatcgtagctgctgtggaggagggccgcgccatctacaacaacatgaagcagttcatccgctacctcatttcctccaacgtgggcgaggtggtctgtatcttcctgaccgctgccctggggctgcctgaggccctgatcccggtgcagctgctatgggtgaacttggtgaccgacgggctcccagccacagccctgggcttcaacccaccagacctggacatcatggaccgccccccccggagccccaaggagcccctcatcagtggctggctcttcttccgctacatggcaatcgggggctatgtgggtgcagccaccgtgggagcagctgcctggtggttcctgtacgctgaggatgggcctcatgtcaactacagccagctgactcacttcatgcagtgcaccgaggacaacacccactttgagggcatagactgtgaggtcttcgaggcccccgagcccatgaccatggccctgtccgtgctggtgaccatcgagatgtgcaatgcactgaacagcctgtccgagaaccagtccctgctgcggatgccaccctgggtgaacatctggctgctgggctccatctgcctctccatgtccctgcacttcctcatcctctatgttgaccccctgccgatgatcttcaagctccgggccctggacctcacccagtggctcatggtcctcaagatctcactgccagtcattgggctcgacgaaatcctcaagttcgttgctcggaactacctagagggataactgttccccctcctccatctctgagcccgtgtcacagatccagaagatgaaagaaggaagtgagcatccttttgctctgtcctccccaccccgatagtgacacatcttcaggcagagctgtggcacagacccccgtcctgtcccccacacccgtgtcatgtgtctgtttataaacatgtccccttccctttccttccccctcggccacccgcctccctctcaaccttgtaaattccccttcccaaccccgaggggcttgcagggacaaggcgaccgactgcgctgagctgcttatttattgaaaataaacgacggaaaagtc

SEQ ID NO: 2715 - DNA, 4453 bp, Homo sapiens
gcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgat

SEQ ID NO: 2716 - DNA, 8229 bp, Homo sapiens
ggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatg

SEQ ID NO: 2717 - DNA, 4094 bp, Homo sapiens
cccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataa

SEQ ID NO: 2718 - DNA, 2951 bp, Homo sapiens
aacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgact

SEQ ID NO: 2719 - DNA, 6777 bp, Homo sapiens
ggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctg

SEQ ID NO: 2720 - DNA, 6669 bp, Homo sapiens
ggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctg

SEQ ID NO: 2721 - DNA, 6970 bp, Homo sapiens
acagatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagatggatgtagtgaatgctttccagagtggaagttccattcagggggctctaaggcggcaaccctccatcgccagccagcatcatgatgtaacaaatatttctacccctacacatgtagtgttttcctcttctactgcttctactactgtggggtattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgt

SEQ ID NO: 2722 - DNA, 3127 bp, Homo sapiens
tttcctaaatgttgaggctgttaaaaacaatattactgaagtttgaaatttggtggtagcaaggagatctatcagtatttttaaaaacaaactatgtttttggttataggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatt

SEQ ID NO: 2723 - DNA, 7032 bp, Homo sapiens
agcgtgagtagggagccccggctggtggacgccgagcctctcggctccttggccgccccatccccgaggtgcagctgcacctccgcgtggcgccccgagccctgcgagccggctgcggacgcgctgaggacggagcccccatcctctgcgtttcccgctgccccttaacgccccgcgaccctcccgcagcctgcctttccttccccctcggaaaatggttcccactgccgggcgagatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaa

SEQ ID NO: 2724 - DNA, 607 bp, Homo sapiens
gtggcagcgggagcagctgcgccgccagcgtggagcgggaggcgtgtgggtgtggagaaaagggagcgccagaccggaacggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtgagttttattatgcttgtttttggttctttgtgcaaagagttctatatatttggcttataaatgagcatgcttatattatcttggcgattgtat

SEQ ID NO: 2725 - DNA, 4036 bp, Homo sapiens
agtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtgtgaagaagggggatggccttcagctaccagcagcagacggtgcggcagcttcaaatgctgcagatagtgcgaatgccagcctagtcaatggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagattgaagtagtcaatactttcaagagcggggcctcctttcagggggccctgcggagacagtcctcggtcaccagccagagccaggatgtagccaatctctctagccctagtcgcgtgtcgttgtccaatgctctttcctctccgaccagccttcctcctgctgcagccgggcgtgag

SEQ ID NO: 2726 - DNA, 8920 bp, Homo sapiens
agtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtgtgaagaagggggatggccttcagctaccagcagcagacggtgcggcagcttcaaatgctgcagatagtgcgaatgccagcctagtcaatgccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 2727 - DNA, 8593 bp, Homo sapiens
agccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtgtgaagaagggggatggccttcagctaccagcagcagacggtgcggcagcttcaaatgctgcagatagtgcgaatgccagcctagtcaatggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 2728 - DNA, 8962 bp, Homo sapiens
agtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtgtgaagaagggggatggccttcagctaccagcagcagacggtgcggcagcttcaaatgctgcagatagtgcgaatgccagcctagtcaatggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 2729 - DNA, 8900 bp, Homo sapiens
ggcgagatgctctcctagaaccggcgccggcgcctccgccccccgccccccacccgctcgggcaggatggtacagtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 2730 - DNA, 8964 bp, Homo sapiens
gggcagccgcggcagaggagccgcagccgcagcggggccgggccgggccgggcgcgcaccagcggcagcggcggcggcagcggcggcggcagcatctcgctctcggagccggcgcaggtttccctgtacttagagcgtggactgtgaacccccaagcagacgagctgaacttcgtcacccagtccctagagccagcaagacatgggccccagtttccagaccctgacacctctcatttaaccagaagacgtggaggggagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 2731 - DNA, 8053 bp, Homo sapiens
agtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtgtgaagaagggggatggccttcagctaccagcagcagacggtgcggcagcttcaaatgctgcagatagtgcgaatgccagcctagtcaatggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 2732 - DNA, 8869 bp, Homo sapiens
agtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 2733 - DNA, 6420 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctg

SEQ ID NO: 2734 - DNA, 4280 bp, Homo sapiens
ccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggag

SEQ ID NO: 2735 - DNA, 4234 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggag

SEQ ID NO: 2736 - DNA, 6532 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctg

SEQ ID NO: 2737 - DNA, 6742 bp, Homo sapiens
ccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctggtctgggtaa

SEQ ID NO: 2738 - DNA, 4064 bp, Homo sapiens
cagccaacagtcgctctaaatgggccttactctaactgatggatcctgtctgccctatagcctgttgcattcatgaagacagtgagggttagcagagcaccccgaccccaccctgtcctccaggatggagactccacctcccaggactccaagttcctcccctgtgggccaggcccccattcactcattcctccaggcccccggccacatgcgggactgaccacgcggtagacttcctgccgactccataccacgtgtctcaaagagcttagggcccagtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggca

SEQ ID NO: 2739 - DNA, 4658 bp, Homo sapiens
gctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcaagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtga

SEQ ID NO: 2740 - DNA, 613 bp, Homo sapiens
ggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcagtgagtgatagtctattatgatgcatgatttgctaaaatgaccacaagagagcacgtggcatccactttaaccaaccatggttatcttttccttttggtttttccctttgatattttgacttaagggaagaaaaagacaaaaatcctactctaaaaccagactgtgtgcccttgtattttatttttgtaatgtagaaaagctattaaaccttaactgttttaaagacaataa

SEQ ID NO: 2741 - DNA, 8968 bp, Homo sapiens
caccctcacccctcctccacccctactcagctttctattcaacaagtgagagcaagggcggggaagaaagccgacaggggagaggattgcttccctttcttttcccattcccccttaagacgaaccaggaagtaaccgcaagaatcgggccaccttaacagtagagtaatggtttggcctcgcgccaagtcccacctctgttccagctcctgctcctcccctctctcttcccgcactgcttggggagagctggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcaagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattcttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 2742 - DNA, 8905 bp, Homo sapiens
ttggggagagctggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcaagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattcttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgt

SEQ ID NO: 2743 - DNA, 8869 bp, Homo sapiens
ttggggagagctggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcaagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattcttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgt

SEQ ID NO: 2744 - DNA, 8797 bp, Homo sapiens
ttggggagagctggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcaagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattcttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgt

SEQ ID NO: 2745 - DNA, 429 bp, Homo sapiens
ttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagcatcttttgcaggattcagacttgcttcctgacaaggaggaagcaataatttcttcaagcctcttcccttcttgcaatttctgaaatgggatagaagccacccctgctgctcttatgtcccctgtctatagccccacaataacttttattttttccactt

SEQ ID NO: 2746 - DNA, 3484 bp, Homo sapiens
gctggcgtgagctggggacgttgcgggcacacgacggggcgggtgcgggatcttggggaggggggctcccgagatagtggctgggcggggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactgggtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatatta

SEQ ID NO: 2747 - DNA, 3339 bp, Homo sapiens
aaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtttccagctcttcaggtaactttgttgctgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccg

SEQ ID NO: 2748 - DNA, 3401 bp, Homo sapiens
gggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaat

SEQ ID NO: 2749 - DNA, 3446 bp, Homo sapiens
ggacgcttctagacagtgttcatacttggctgtctggtttcaccaggaactctacccaaaagaggaaacagcaaggagaacatttgctttgtttgtaggagggaagttgtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcgg

SEQ ID NO: 2750 - DNA, 3386 bp, Homo sapiens
gggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatatta

SEQ ID NO: 2751 - DNA, 4795 bp, Homo sapiens
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 2752 - DNA, 4714 bp, Homo sapiens
cttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttgggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 2753 - DNA, 556 bp, Homo sapiens
ctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttggactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcagg

SEQ ID NO: 2754 - DNA, 4888 bp, Homo sapiens
attgcatttctggacgcttctagacagtgttcatacttggctgtctggtttcaccaggaactctacccaaaagaggaaacagcaaggagaacatttgctttgtttgtaggagggaagttgtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 2755 - DNA, 3579 bp, Homo sapiens
tttctggacgcttctagacagtgttcatacttggctgtctggtttcaccaggaactctacccaaaagaggaaacagcaaggagaacatttgctttgtttgtaggagggaagttgtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatatta

SEQ ID NO: 2756 - DNA, 540 bp, Homo sapiens
gactgactaagaggagtagttaaaatggagaaagcttagctgtactttgtcttgcatgttaaacgtaatgagtttagaggattatgattatttgtaatcatcaggatctgctagacaggacatctgttttactttttactcttatgttggtggagaaatagcgtgcttttcattcaatgtgaaaattttgtgttctagctgggcaccgatggcttagtttttgaaatgtaatttcttgagaagtagcatgtggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcat

SEQ ID NO: 2757 - DNA, 4969 bp, Homo sapiens
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttggtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 2758 - DNA, 559 bp, Homo sapiens
aggttctgaaggaaggggaggttcgggtatcccctggatgggggggcatctctagggcgccgccccgctggcatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatg

SEQ ID NO: 2759 - DNA, 5067 bp, Homo sapiens
tctctcagcggaagtaatagtgacaaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttggatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattc

SEQ ID NO: 2760 - DNA, 3439 bp, Homo sapiens
cttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttgggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 2761 - DNA, 3277 bp, Homo sapiens
atatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggttgcacgttttcaaaaaatacctaatggtgaaaatgagacaatgattcctgtattgacatcaaaaaaagcaagtgaattaccagtcagtgaagttgcaagcattctccaatttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaa

SEQ ID NO: 2762 - DNA, 3384 bp, Homo sapiens
gggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttgattgatgaacagagtgagctgaaagccatcgagaaagagaagaaggtgacagccctgccccccaaggaagcgtgcaaatgccagaaagaggatttggccagagcgttttgtgtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagatggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataatt

SEQ ID NO: 2763 - DNA, 3471 bp, Homo sapiens
gggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttgattgatgaacagagtgagctgaaagccatcgagaaagagaagaaggtgacagccctgccccccaaggaagcgtgcaaatgccagaaagaggatttggccagagcgttttgtgtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagatggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagaggagttcccagaaaactgaagtgtgttgcactgcagtgagactgggagtagaaggcagaggagaaagtacctgggccggcagagctggcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataatt

SEQ ID NO: 2764 - DNA, 2782 bp, Homo sapiens
agttctcagtgttctgggaatgttattcatcgatgcgttttggcagcaaaataggcttctggtttaagaaccccctgatcctgctgctgctgggctctgccctggtgagtgtcctcaccaaggagtatgaggacgccgtcagcatcgccacggcagtgcttgtcgtggtcactgtcgccttcatccagcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttatt

SEQ ID NO: 2765 - DNA, 4799 bp, Homo sapiens
ccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 2766 - DNA, 4786 bp, Homo sapiens
ccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccggaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 2767 - DNA, 4857 bp, Homo sapiens
ccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgggccagggacacagcatcgtctcgctgtcagagctgctcagagagggaggaagcagggaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 2768 - DNA, 4205 bp, Homo sapiens
ccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgaagaaatgagccagaagtgagcgctgggaacagagtggagtctccgggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 2769 - DNA, 4162 bp, Homo sapiens
ccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgggccagggacacagcatcgtctcgctgtcagagctgctcagagagggaggaagcagggaagaaatgagccagaagtgagcgctgggaacagagtggagtctccgggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 2770 - DNA, 4698 bp, Homo sapiens
ccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 2771 - DNA, 3145 bp, Homo sapiens
ccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacggtcacacccagagt

SEQ ID NO: 2772 - DNA, 4695 bp, Homo sapiens
ccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 2773 - DNA, 2111 bp, Homo sapiens
agctcgcggtgtccccgagcgccggcggccgggaggatggcctgggctgcgggtggggcgcgcgcccgacggctggggctcccctctgagcggctgcggctcctgcacctccccggggagccgccccgtcgatgccactaaggccaaggacatatagacggtctgccctcccccactcaaaccgggatcatgacggtccccaaggagatgcccgagaagtgggcccgggcccaggcgcctccctcttggagccgaaagaagccctcttgggggacagaagaagaaaggagggcgcgggctaatgaccgagaatacaatgagaaattccagtatgcgagtaactgcatcaagacctccaagtacaatattctcaccttcctgcctgtcaacctctttgagcagttccaggaagttgccaacacttacttcctgttcctcctcattctgcagttgatcccccagatctcttccctgtcctggttcaccaccattgtgcctttggttcttgtcctcaccatcacagctgttaaagatgccactgatgactatttccgccacaagagcgataaccaggtgaataaccgccagtctcaggtgctgatcaatggaatcctccagcaggagcagtggatgaatgtctgtgttggtgatattatcaagctagaaaataaccagtttgtggcggcggatctcctcctcctttccagcagtgagccccatgggctgtgttacatagagacagcagaacttgatggcgagaccaacatgaaagtacgtcaggcgattccagtcacctcagaattgggagacatcagtaagcttgccaagtttgacggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatgttgggtctgaggggcctagaagaaagggtccatcctggccaggcacggtggctcatgcctatagtcatagcactttgggaggctgaggtgggaggattgctcgagcccaggaatgcgagaccagcctgggcaacatagtgagaccacatccctacaaaaaatttaaaaattagccaggtatggtggcatgcacctgtggtctcagctggccagtgactcaggaggctgagatgggaggatcacttgagcctgggaggtcaaggctgcagtgagccatgatcttccactgcactccagcctgggcgacagaatgaggccctgtctctcgagaaaaatccacacacaaagaagaggtccattctgtgtcccatgtcaagaagcagatcctggctgggcgcagtggatcacctgaggtcaagtgttcgagaccagcttggccaacatggtgaaactccgtctctactaaaaatacaaaaaatagctgggcgtggtggcaggtgcctgttttcccagctactcggggggctgaggcaggagaattgcttgaatccaggaggtggaggttacagtgagccgagtttgcgccattgtactccagcctgggcgacaagagtgaaagtct

SEQ ID NO: 2774 - DNA, 1523 bp, Homo sapiens
cacaaagtagcgggccgaggccccgggggagcggggccgcagctgggggggcgggagcccgtggggagccgagccgagcgccccccgccccagcccccggcatgggcagtacggggccgccggggcgggcgccgagcgctgagcgctgagggtctcccatgggattgctgggatcttgctgggtgagatggcagtgtgtgcaaaaaagcgccccccagaagaagaaaggagggcgcgggctaatgaccgagaatacaatgagaaattccagtatgcgagtaactgcatcaagacctccaagtacaatattctcaccttcctgcctgtcaacctctttgagcagttccaggaagttgccaacacttacttcctgttcctcctcattctgcagttgatcccccagatctcttccctgtcctggttcaccaccattgtgcctttggttcttgtcctcaccatcacagctgttaaagatgccactgatgactatttccgccacaagagcgataaccaggtgaataaccgccagtctcaggtgctgatcaatggaatcctccagcaggagcagtggatgaatgtctgtgttggtgatattatcaagctagaaaataaccagtttgtggcggcggatctcctcctcctttccagcagtgagccccatgggctgtgttacatagagacagcagaacttgatggcgagaccaacatgaaagtacgtcaggcgattccagtcacctcagaattgggagacatcagtaagcttgccaagtttgacggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcaggtatgtgccttctctgacctggggtctctccagggagtcaggcggtcccatagaacttttcttttctatgaagatgaagtccttgagaagtaacgagaagtcctcttcttcctgtactgtaaacatttgatgttatctgtttatctttgtgggcagagcaaactttttaccacagtttcctggtacttgggactgtattagagaaaaaaaaatattgatttattcagcacctatttattacatgcctactgtgtacaaagaagtgtgctaggtgccatcacaaataaaagatgaattaggaa

SEQ ID NO: 2775 - DNA, 5861 bp, Homo sapiens
atggataccttgagagctgttccccttttttcaatatctggcctcttctcctttccctacagggtctcccatgggattgctgggatcttgctgggtgagatggcagtgtgtgcaaaaaagcgccccccagaagaagaaaggagggcgcgggctaatgaccgagaatacaatgagaaattccagtatgcgagtaactgcatcaagacctccaagtacaatattctcaccttcctgcctgtcaacctctttgagcagttccaggaagttgccaacacttacttcctgttcctcctcattctgcagttgatcccccagatctcttccctgtcctggttcaccaccattgtgcctttggttcttgtcctcaccatcacagctgttaaagatgccactgatgactatttccgccacaagagcgataaccaggtgaataaccgccagtctcaggtgctgatcaatggaatcctccagcaggagcagtggatgaatgtctgtgttggtgatattatcaagctagaaaataaccagtttgtggcggcggatctcctcctcctttccagcagtgagccccatgggctgtgttacatagagacagcagaacttgatggcgagaccaacatgaaagtacgtcaggcgattccagtcacctcagaattgggagacatcagtaagcttgccaagtttgacggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatggtgatgtgtttgacgtcctgggacacaaagctgaattgggagagaggcctgaacctgttgacttctccttcaatcctctggctgacaagaagttcttattttgggaccccagcctgctggaggctgtcaagatcggggacccccacacgcatgagttcttccgcctcctttccctgtgtcatactgtcatgtcagaagaaaagaacgaaggagagctgtactacaaagctcagtccccagatgagggggccctggtcaccgcagccaggaactttggttttgttttccgctctcgcacccccaaaacaatcaccgtccatgagatgggcacagccatcacctaccagctgctggccatcctggacttcaacaacatccgcaagcggatgtcggtcatagtgcggaatccagaggggaagatccgactctactgcaaaggggctgacactatcctactggacagactgcaccactccactcaagagctgctcaacaccaccatggaccaccttaatgagtacgcaggggaagggctgaggaccctggtgctggcctacaaggatctggatgaagagtactacgaggagtgggctgagcgacgcctccaggccagcctggcccaggacagccgggaggacaggctggctagcatctatgaggaggttgagaacaacatgatgctgctgggtgcaacggccattgaggacaaacttcagcaaggggttccagagaccattgccctcctgacactggccaacatcaagatttgggtgctaaccggagacaagcaagagacggctgtgaacatcggctattcctgcaagatgctgacggatgacatgactgaggttttcatagtcactggccatactgtcctggaggtgcgggaggagctcaggaaagcccgggagaagatgatggactcatcccgctccgtaggcaacggcttcacctatcaggacaagctttcttcttccaagctaacttctgtcctggaggccgttgctggggagtacgccctggtcataaatggtcacagcctggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaacggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggcttcttctgtggcttctcagcccagaccgtctatgaccagtatttcatcaccctgtataacatcgtgtacacctccctgccagtcctggctatgggggtctttgatcaggatgtccccgagcagcggagcatggagtaccctaagctgtatgagccgggccagctgaaccttctcttcaacaagcgggagttcttcatctgcatcgcccagggcatctacacctccgtgctcatgttcttcattccctatggggtgtttgctgatgccacccgggatgatggcactcagctggctgactaccagtcctttgcagtcactgtggccacatccttggtcattgtggttagcgtgcagattgggctcgacacaggctactggacggccatcaaccacttcttcatctggggaagccttgctgtttactttgccatcctctttgccatgcacagcaatgggctcttcgacatgtttcccaaccagttccggtttgtggggaatgcccagaacaccttggcccagcccacggtgtggctgaccattgtgctcaccacagtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccagtggcggtgccgacaagcccctcaagggctgaaggccgaggatggatgccctgtgccagtgaccagagcacccagggctggccagtcactgagggaacagcgtctcggaactgctggtcctcattccttgcttcccgtccccccggtagactctgtcctgctggtcccaccacacatggctgggacatctgttcccagctgtaggcccttccaccagctggggagctagagggagcaggcccaagggcagagcagaggctgaggcacggggagccagccccactcggggaccagaagtggaaccaaaaacaagaaaaaactgtgagagattgtgtctgcccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttttttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggtagttttcttttcttttttctttttctttttttctttttttttttgagatggagtctcactcttgtcacctaggcaagagtgcaatggcacaatctcagctcactgcaacctccacctcctgggttcaagcgattctcctgcctcagcctcctgagtagctgggattacaggcacacaccaccacgcttggttaatttttgtatttttagtagagatgtttcaccatgttggccaggctagtcttgaattcctgacctcctgacctgcccacctcaacctcccaaagtgctgagattacaggcgtgagccaccacacccagctcagggaggcgtagttttctttaattttaaatttaaacccaagtttattggcagactcccttttgacctccctttgcctccccatctggtgctttcttgcatctacaccccagggccctgtggtggggctgcagggggaagctgtgcacctgagatgaggctggaacgggaattggcctctctgctcccttcttcagtaagcaaggagccccgcccctcaggcccagcctctggcaagaggtggtggaatccttgtgccgggtagtagaggaggataagggcaaaaccaggcccaggccagtgcctggcttggtctggatgggacactgtcagagtttggccacagcctgtcctttacttcatccacacctatgaagctattccctaaataaggcatttcccaagttagtcgctacctaatcagccttgagaagaatcctttcctcttctttgatagtgggtcgggggattcttcaggaatggtttggagctgggagtgggtagggggattttaaatgttccatatgggagccccaaaggaactggatgggctgcagtgaggtgggggcgggtgggcagggaatgggagaggggaagtcttggcagggaaatcccttttggccacacagtttacaaacccagtatcatgtctgtctgtgtgtctctcaaggtgagagtctgatttttataccaaagaggaaatgattttttttcatattttgtttgtctatattatataaatatatatatacagttatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctgagaa

SEQ ID NO: 2776 - DNA, 3457 bp, Homo sapiens
ggtcggaacatggcggaccagatcccgctttacccggtgcgtagcgcagcggcggccgcagccaaccgcaaacgcgcggcctactacagcgccgcggggcccaggccgggagccgaccggcacagcaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggtactgtaataggtgttgtcatttataccggaaaagagactcgaagtgtaatgaacacatccaatccaaaaaataaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggaaccctcacccagaatgaaatgatatttaagcggctgcacctgggcaccgtgtcctatggcgccgacacgatggatgagatccagagccatgtcagggactcctactcacagatgcagtctcaagctggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagtgcggaaacatggctcgcgaaggactgcggaccctcgtggttgcaaagaaggcgttgacagaggagcagtaccaggactttgagagccgatacactcaagccaagctgagcatgcacgacaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttggtataggcagagtgtcttttggagctttcttagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaagggg

SEQ ID NO: 2777 - DNA, 3660 bp, Homo sapiens
ggggcggtcggaacatggcggaccagatcccgctttacccggtgcgtagcgcagcggcggccgcagccaaccgcaaacgcgcggcctactacagcgccgcggggcccaggccgggagccgaccggcacagcaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggtactgtaataggtgttgtcatttataccggaaaagagactcgaagtgtaatgaacacatccaatccaaaaaataaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggaaccctcacccagaatgaaatgatatttaagcggctgcacctgggcaccgtgtcctatggcgccgacacgatggatgagatccagagccatgtcagggactcctactcacagatgcagtctcaagctggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagtgcggaaacatggctcgcgaaggactgcggaccctcgtggttgcaaagaaggcgttgacagaggagcagtaccaggactttgagagccgatacactcaagccaagctgagcatgcacgacaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagagccaacaagacggcaggtcaaacagaagacaacatgaacgtctaacctcaggcaccagtggacacgtgtgggacccaggcagcttcttcaggattcgggtgtcaggaaaaggcgcccgaaatgctgggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcacca

SEQ ID NO: 2778 - DNA, 4320 bp, Homo sapiens
ggggcggtcggaacatggcggaccagatcccgctttacccggtgcgtagcgcagcggcggccgcagccaaccgcaaacgcgcggcctactacagcgccgcggggcccaggccgggagccgaccggcacagcaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggtactgtaataggtgttgtcatttataccggaaaagagactcgaagtgtaatgaacacatccaatccaaaaaataaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggaaccctcacccagaatgaaatgatatttaagcggctgcacctgggcaccgtgtcctatggcgccgacacgatggatgagatccagagccatgtcagggactcctactcacagatgcagtctcaagctggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagtgcggaaacatggctcgcgaaggactgcggaccctcgtggttgcaaagaaggcgttgacagaggagcagtaccaggactttgagagccgatacactcaagccaagctgagcatgcacgacaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcac

SEQ ID NO: 2779 - DNA, 1556 bp, Homo sapiens
gcgccgcggggcccaggccgggagccgaccggcacagcaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgatgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgaatgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttacagttcatatggaaccaaaaaagagtctgcatcgccaaatcaatcctaagccaaaagaacaaagctggaggcatcacactacctgacttcaaactatactacaaggctacagtaaccaaaacagcatggtactggtaccaaaacagagatatagatcaatggaacagaagagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcaataccattcaggacataggcatgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaattt

SEQ ID NO: 2780 - DNA, 854 bp, Homo sapiens
aaaggggcggtcggaacatggcggaccagatcccgctttacccggtgcgtagcgcagcggcggccgcagccaaccgcaaacgcgcggcctactacagcgccgcggggcccaggccgggagccgaccggcacagcaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcagtatcaaacaatcttgattactgcagccatctggttttattcattttctgttttttaaat

SEQ ID NO: 2781 - DNA, 2035 bp, Homo sapiens
gtataatgactggctggaagaggagtgcggaaacatggctcgcgaaggactgcggaccctcgtggttgcaaagaaggcgttgacagaggagcagtaccaggactttgagagccgatacactcaagccaagctgagcatgcacgacaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacgg

SEQ ID NO: 2782 - DNA, 6680 bp, Homo sapiens
ccgcaggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcctgagctgtctgacgtctttgatttcttcatcgcactcaccatctgcaacacagtcgtcgtcacgtccccggatcagccacgaacaaaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccagattgtttttcagatccctccaggggagggttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgccaggggaggctgtcctgaggagtccaggagggtgtcctgaggagtccaaggtgagagctgccagcaccggcagggtgacccccctgtcttccctcttcagcctgcctaccttcagcttactcaactggatttcctcctggtcgctggtcagcaggctggggagtgtcttacagttctcccggacggagcagcttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatattatttatgtttattatttgcacagaagagttctagggagatgtatttctaaatgtttcccaggctaatacaggaaacaagaggtaccaaaaaagaaagtttattttttaaaattctaagtagagtatattgaaaagaaaaagaagagccttaacatatataaaagtttaaagaagagtaacacttgaaaagtgtgtttagatttattttttcatctcatttttaagaacaagcagtacgatttgttttcttcaacatgtgtgactgcgcactgagtacaaatgtgtgactgctcatggttaatgcaggcaggtgtgaacatgggggaacaatgagcagagatggcagagggcagagcacatggcccccagaggcttccagtctcactgacacaggagggctgggctccacttcatccagatgaaggaaaggaagacctcaagaaaaattcacagttgagtgcatcccagcattctgttccgggcaggcatttcaggaagaccgccttgtaggtattacatccctggtgtcgtattttgcctgttaaatcgtaacaagcaataaacaactttcactttgcaaagacagtgtgtccagttaccactggtgtatgaaatgattaatacctgacctcacagagtatgatctcagggcacttccgtaaggcaagtccttttagaggctatgaagaaaacagctgcatggcacataccaaagctgctgcacagctggccaccatggcaccctgcaccaggccatcagcaccacgtgccaaggagctcagcggtcttcaggcatttttgtaatgagccattagttctgtccctctaaaactagaaaaggaagggcaggaaatgataacaacccaaggcaatgatatggcatgtcatcttccgagcccttctttctactttgtcaaacagttcttagttgctggctctgctcggcaccgggactgtgaagggtgtactccctgctgtgtgggagggacctagggcctctttggatgctgtcttcgaggacagcaatgcagagagggcataggatctgaggacaaggaaattcctcagcatggcgtatcaggaaagcatggctcattctgcaatgagccatgagtgtgggccatcgcaagtcacagaaaatgcacctcattccagtcaagcagaaaaacaggcacaggctcagtgtaggtcccaagagagggtgcctggactcagcaactcagacctgggcttttctcccagctttcagggacagctttgtcctgagtctgcctctgttcacggggatgcttggctggagtcacccccaggacttatccatgcatcactattcagaagacacagagggcccctctctccacattccaaacagagtcctggtttcctcagcctcaccctgcatagcttgcacaacatcctcagaaccattcactggcaaatggaggggaacgtgctgactgggactcccagctggagctgggaggagaggtccacttcccttagaacacctgagctgctgcatgagtggacgtcagaagaatctctatgccctgttaaatggggagacaaaggggtggtgggggcttcagccagtgatttcggaccgaaggtgacagccgtcccaaccctgcccagcctgatgccacctcctctgttcttggaacaacgcataggaaaagaatctcctttggaaggtgacactgctccctgaattaaggtaatggttgcgagcaccaagtacaaggactagacgcatatttacctgcgtatctgagagttccagattcccagcttccagatgatccttgcacagacaacctaccttctttccagaggatgtctttctcctctggagagtagatgcttgctcttgggaaacggaatgaccttggcgctggcttcaggaatatgcatcccacagccagtttagagaaatacatgttgtaaatggcattgacagctgctctttaggatggggagtattatggaaatccacaataacaatctatggcaagcaact

SEQ ID NO: 2783 - DNA, 3493 bp, Homo sapiens
gcggccgcactagtaccccggagcccatgggcgcgccgagccgggcgcgggggcgctgaacggcggagcgggagcggccggaggagccatggactgcagcctcgtgcggacgctcgtgcacagatactgtgcaggagaagagaattgggtggacagcaggaccatctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctga

SEQ ID NO: 2784 - DNA, 8768 bp, Homo sapiens
gcggccgcactagtaccccggagcccatgggcgcgccgagccgggcgcgggggcgctgaacggcggagcgggagcggccggaggagccatggactgcagcctcgtgcggacgctcgtgcacagatactgtgcaggagaagagaattgggtggacagcaggaccatctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaa

SEQ ID NO: 2785 - DNA, 8795 bp, Homo sapiens
gcggccgcactagtaccccggagcccatgggcgcgccgagccgggcgcgggggcgctgaacggcggagcgggagcggccggaggagccatggactgcagcctcgtgcggacgctcgtgcacagatactgtgcaggagaagagaattgggtggacagcaggaccatctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctgatggaacaagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaa

SEQ ID NO: 2786 - DNA, 3163 bp, Homo sapiens
tctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacaggtaccatcctccaaacagcctctcctgagagcagagagagtaactaggcagcactctggcagttccttccaatagccacctggcagacctcagttgagggccagaagcattcggcatctgctgatattcttgcttgatcaggagcttgtttaaactggaagcaacatagctcaaatggagattcttcaagtcttgctggatggtttatgctgcatttggaacatctgtgtggagccagtttgcactttcctgtgctttctgacagtcctgagggagctggggtacaagcgtcttcctcgttgtgaccctagggaatctgtggcctaagttatcctttaaaaccatgtgtgttccattcagtgagaaaaaacaaaaattaacagc

SEQ ID NO: 2787 - DNA, 2720 bp, Homo sapiens
tctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagggacgtcgccaagaatgccctgctgcgctggcgcgtgttcatctactggacgctcctgggactgtttga

SEQ ID NO: 2788 - DNA, 5786 bp, Homo sapiens
cttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctgatggaacaagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgc

SEQ ID NO: 2789 - DNA, 8858 bp, Homo sapiens
gcggccgcactagtaccccggagcccatgggcgcgccgagccgggcgcgggggcgctgaacggcggagcgggagcggccggaggagccatggactgcagcctcgtgcggacgctcgtgcacagatactgtgcaggagaagagaattgggtggacagcaggaccatctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctgatggaacaagcagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaa

SEQ ID NO: 2790 - DNA, 7325 bp, Homo sapiens
ggtcaataatgaaggtggctgcggcgcggcggcaggctcagctgcgccgggcgggggcggcgccggggccgcgcctgtaggactcggggccgacgccgcgggatggggacgcggcgcggggagtgaggcagtggcggcggcggcggtaagcggaacttcggcccgaggggctcgcccgctcccgcctctgtcttgtcggcctccacctgcagccccgcggcccccgcgccccgcgggacccggacggcgacgacgggggaatgtggcgctggatccggcagcagctgggttttgacccaccacatcagagtgacacaagaaccatctacgtagccaacaggtttcctcagaatggcctttacacacctcagaaatttatagataacaggatcatttcatctaagtacactgtgtggaattttgttccaaaaaatttatttgaacagttcagaagagtggcaaacttttattttcttattatatttttggttcagcttatgattgatacacctaccagtccagttaccagtggacttccattattctttgtgataacagtaactgccataaagcagggatatgaagattggttacggcataactcagataatgaagtaaatggagctcctgtttatgttgttcgaagtggtggccttgtaaaaactagatcaaaaaacattcgggtgggtgatattgttcgaatagccaaagatgaaatttttcctgcagacttggtgcttctgtcctcagatcgactggatggttcctgtcacgttacaactgctagtttggacggagaaactaacctgaagacacatgtggcagttccagaaacagcattattacaaacagttgccaatttggacactctagtagctgtaatagaatgccagcaaccagaagcagacttatacagattcatgggacgaatgatcataacccaacaaatggaagaaattgtaagacctctggggccggagagtctcctgcttcgtggagccagattaaaaaacacaaaagaaatttttggtgttgcggtatacactggaatggaaactaagatggcattaaattacaagagcaaatcacagaaacgatctgcagtagaaaagtcaatgaatacatttttgataatttatctagtaattcttatatctgaagctgtcatcagcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatataattaaaa

SEQ ID NO: 2791 - DNA, 2218 bp, Homo sapiens
taatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagatgtactccaacacagttgctttaagtgacgagttcatcgcactgcagccattgtcgagggcaaggaatcagctgagcaaacttagatggaagaagataagggttcagtcagctcagcatatgaatttgctgaaagccagcacagaggggaggacagtaggcacctgctag

SEQ ID NO: 2792 - DNA, 8483 bp, Homo sapiens
tgctgccgccgccgcagccgcagctactgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaaagcttaggttttgaagcttctttggtcaagaaggatcggtcagcaagtcacttagatcataaacgagaaataagacaatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaagggcaaaacatcagaggctcttgcaaagttaatttcactacaagctacagaagcaactattgtaactcttgattctgataatatcctcctcagtgaagaacaagtggatgtggaacttgtacaacgtggagatatcattaaagtagttccaggaggcaaatttccagtggatggtcgtgttattgaaggacattctatggtagatgagtccctcatcacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggctcctatccagcagtttgcagacaaactcagtggctattttgttccttttattgtttttgtttccattgccaccctcttggtatggattgtaattggatttctgaattttgaaattgtggaaacctactttcctggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaaatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatgatgagctgtgtggcttgatagccattgcagacacagtgaagcctgaagcagaactggctatccatattctgaaatctatgggcttagaagtagttctgatgactggagacaacagtaaaacagctagatctattgcttctcaggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataaggaatgatcttctggatgtagtggcaagtattgacttatcaagagagacagtcaagaggattcggataaattttgtctttgctctaatttataatctggttggaattcccatagctgctggagtttttatgcccattggtttggttttgcagccctggatgggatctgcagcaatggctgcttcatctgtttctgtagtactttcttctctcttccttaaactttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccaagtttaggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataatcactttgctagtatatataatttaatagattttatttatcttttagtgtttcagataacctctcaaaaagactttaaaataatgctattacacaaagctgcatttaccaaaaaatacagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatcaggtgggggtaggggatggagttcttcctttcctaccccttttctcttttatcctttcatatatacacatgcaaagtttacaaccttattccatgctgtctttcagatttagaaaagatctaatttctgtctcagctgtcttaaagagagaactgaagcttttgatgaaggtgctattaatctagaaaggcaaacccatttcactgaaatatcaatgggtttgcatatctaggccctttttttagaccaatgcctatgccatcctccatgctttcagtttgagttttattatttattattttaattccagtggcccatcttataatacaacttgtttcttctagaagacagagctgatagggtaaatgttgaaaaaagaagcatgcctccttctccctcccacccacctcaagcagttgaacacagccagttattcttccattattatgtgtaccttggagtcatcctcttggtcttgtattcatattgtgggacagtgggaatagcagcttgtagtattgaaataatcaaagagataatttcagctcttacaacaagaacagaaaacatgctaattagaaaaagtcctgctttaagtaatatgtagccacatttgaatcctctaccacaagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggaaatggatttatatttgaatttgatatttgaatatttgaagttctctatttatatttcatttatcactcttctgtattcactcagcaaccatgcccttagtctgaagataacaaggatactttaatatccagtgccggttcagactcacctatgtggcaccttaaacttaaatatccaaagatgccttttgaatttcaaagattaaaacacagctagagtagtagtattgtagtctcaagatgtatggtgtgtcatttgtgaaaatagaaacgttatttttcctagtttagtatcaacattttagaatgtcaaatttgatgccttgtgaacaagtaattttatattgtgctttaattttttaaaaagtattctttattcatatgtatagaatgcttaaaatagcactgtagacaagatgtttccaaaactttaagtgcgcatatcttttctgtatacagcttaaaatcaaaaatgtatgttaagagaattttttctattacttatggatcatgctttaaaatgatttttcttgatatttattttactccattttgtttttttctctgggtgaggcatctggttactggttattttaaaaagaataaagacattcctggaatcactccttttgggtttttgtttgttttgtttcttttctacatttttaagtattattttacaaaatagaaaaaatatagattcatgccaaattattacctatttttacactaactttctgcagtccctccatctggtatgagtaaccagatagagcacaaagcatgagttcttgttcttcagttaaaagagcttctttcacagtgttgataacaaatgccttttgtagccaaaaccaggcgtctcaaccttacgtttttagttaaagaaatgtttagctaaacgttgttgaacattgattgtttggtaccgaaaacagcagtggacgatgttgtgcaatatccatctactgtagttaagatattcagtagtttgtttttcataagcatgtaattgatcatatttctgccaaggatgtgccttcaactttataattatagtgttgtaaaata

SEQ ID NO: 2793 - DNA, 8254 bp, Homo sapiens
gttgttgctgccgccgccgcagccgcagctactgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaaagcttaggttttgaagcttctttggtcaagaaggatcggtcagcaagtcacttagatcataaacgagaaataagacaatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacagggcaaaacatcagaggctcttgcaaagttaatttcactacaagctacagaagcaactattgtaactcttgattctgataatatcctcctcagtgaagaacaagtggatgtggaacttgtacaacgtggagatatcattaaagtagttccaggaggcaaatttccagtggatggtcgtgttattgaaggacattctatggtagatgagtccctcatcacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggctcctatccagcagtttgcagacaaactcagtggctattttgttccttttattgtttttgtttccattgccaccctcttggtatggattgtaattggatttctgaattttgaaattgtggaaacctactttcctggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaaatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatgatgagctgtgtggcttgatagccattgcagacacagtgaagcctgaagcagaactggctatccatattctgaaatctatgggcttagaagtagttctgatgactggagacaacagtaaaacagctagatctattgcttctcaggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataaggaatgatcttctggatgtagtggcaagtattgacttatcaagagagacagtcaagaggattcggataaattttgtctttgctctaatttataatctggttggaattcccatagctgctggagtttttatgcccattggtttggttttgcagccctggatgggatctgcagcaatggctgcttcatctgtttctgtagtactttcttctctcttccttaaactttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccaagtttaggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataatcactttgctagtatatataatttaatagattttatttatcttttagtgtttcagataacctctcaaaaagactttaaaataatgctattacacaaagctgcatttaccaaaaaatacagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatcaggtgggggtaggggatggagttcttcctttcctaccccttttctcttttatcctttcatatatacacatgcaaagtttacaaccttattccatgctgtctttcagatttagaaaagatctaatttctgtctcagctgtcttaaagagagaactgaagcttttgatgaaggtgctattaatctagaaaggcaaacccatttcactgaaatatcaatgggtttgcatatctaggccctttttttagaccaatgcctatgccatcctccatgctttcagtttgagttttattatttattattttaattccagtggcccatcttataatacaacttgtttcttctagaagacagagctgatagggtaaatgttgaaaaaagaagcatgcctccttctccctcccacccacctcaagcagttgaacacagccagttattcttccattattatgtgtaccttggagtcatcctcttggtcttgtattcatattgtgggacagtgggaatagcagcttgtagtattgaaataatcaaagagataatttcagctcttacaacaagaacagaaaacatgctaattagaaaaagtcctgctttaagtaatatgtagccacatttgaatcctctaccacaagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggaaatggatttatatttgaatttgatatttgaatatttgaagttctctatttatatttcatttatcactcttctgtattcactcagcaaccatgcccttagtctgaagataacaaggatactttaatatccagtgccggttcagactcacctatgtggcaccttaaacttaaatatccaaagatgccttttgaatttcaaagattaaaacacagctagagtagtagtattgtagtctcaagatgtatggtgtgtcatttgtgaaaatagaaacgttatttttcctagtttagtatcaacattttagaatgtcaaatttgatgccttgtgaacaagtaattttatattgtgctttaattttttaaaaagtattctttattcatatgtatagaatgcttaaaatagcactgtagacaagatgtttccaaaactttaagtgcgcatatcttttctgtatacagcttaaaatcaaaaatgtatgttaagagaattttttctattacttatggatcatgctttaaaatgatttttcttgatatttattttactccattttgtttttttctctgggtgaggcatctggttactggttattttaaaaagaataaagacattcctggaatcactccttttgggtttttgtttgttttgtttcttttctacatttttaagtattattttacaaaatagaaaaaatatagattcatgccaaattattacctatttttacactaactttctgcagtccctccatctggtatgagtaaccagatagagcacaaagcatgagttcttgttcttcagttaaaagagcttctttcacagtgttgataacaaatgccttttgtagccaaaaccaggcgtctcaaccttacgtttttagttaaagaaatgtttagctaaacgttgttgaacattgattgtttggtaccgaaaacagcagtggacgatgttgtgcaatatccatctactgtagttaagatattcagtagtttgtttttcataagcatgtaattgatcatatttctgccaaggatgtgccttcaactttataattatagtgttgtaaaata

SEQ ID NO: 2794 - DNA, 400 bp, Homo sapiens
gttgttgctgccgccgccgcagccgcagctactgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtatcactggaagaaaaaaatgcaactattattttttatgcccattggtttggttttgcagccctggatgggatctgcagcaatggctgcttcatctgtttctgtagtactttcttctct

SEQ ID NO: 2795 - DNA, 5497 bp, Homo sapiens
gttgttgctgccgccgccgcagccgcagctactgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaaatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatgatgagctgtgtggcttgatagccattgcagacacagtgaagcctgaagcagaactggctatccatattctgaaatctatgggcttagaagtagttctgatgactggagacaacagtaaaacagctagatctattgcttctcaggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataaggaatgatcttctggatgtagtggcaagtattgacttatcaagagagacagtcaagaggattcggataaattttgtctttgctctaatttataatctggttggaattcccatagctgctggagtttttatgcccattggtttggttttgcagccctggatgggatctgcagcaatggctgcttcatctgtttctgtagtactttcttctctcttccttaaactttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccaagtttaggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataatcactttgctagtatatataatttaatagattttatttatcttttagtgtttcagataacctctcaaaaagactttaaaataatgctattacacaaagctgcatttaccaaaaaatacagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatcaggtgggggtaggggatggagttcttcctttcctaccccttttctcttttatcctttcatatatacacatgcaaagtttacaaccttattccatgctgtctttcagatttagaaaagatctaatttctgtctcagctgtcttaaagagagaactgaagcttttgatgaaggtgctattaatctagaaaggcaaacccatttcactgaaatatcaatgggtttgcatatctaggccctttttttagaccaatgcctatgccatcctccatgctttcagtttgagttttattatttattattttaattccagtggcccatcttataatacaacttgtttcttctagaagacagagctgatagggtaaatgttgaaaaaagaagcatgcctccttctccctcccacccacctcaagcagttgaacacagccagttattcttccattattatgtgtaccttggagtcatcctcttggtcttgtattcatattgtgggacagtgggaatagcagcttgtagtattgaaataatcaaagagataatttcagctcttacaacaagaacagaaaacatgctaattagaaaaagtcctgctttaagtaatatgtagccacatttgaatcctctaccacaagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggaaatggatttatatttgaatttgatatttgaatatttgaagttctctatttatatttcatttatcactcttctgtattcactcagcaaccatgcccttagtctgaagataacaaggatactttaatatccagtgccggttcagactcacctatgtggcaccttaaacttaaatatccaaagatgccttttgaatttcaaagattaaaacacagctagagtagtagtattgtagtctcaagatgtatggtgtgtcatttgtgaaaatagaaacgttatttttcctagtttagtatcaacattttagaatgtcaaatttgatgccttgtgaacaagtaattttatattgtgctttaattttttaaaaagtattctttattcatatgtatagaatgcttaaaatagcactgtagacaagatgtttccaaaactttaagtgcgcatatcttttctgtatacagcttaaaatcaaaaatgtatgttaagagaattttttctattacttatggatcatgctttaaaatgatttttcttgatatttattttactccattttgtttttttctctgggtgaggcatctggttactggttattttaaaaagaataaagacattcctggaatcactccttttgggtttttgtttgttttgtttcttttctacatttttaagtattattttacaaaatagaaaaaatatagattcatgccaaattattacctatttttacactaactttctgcagtccctccatctggtatgagtaaccagatagagcacaaagcatgagttcttgttcttcagttaaaagagcttctttcacagtgttgataacaaatgccttttgtagccaaaaccaggcgtctcaaccttacgtttttagttaaagaaatgtttagctaaacgttgttgaacattgattgtttggtaccgaaaacagcagtggacgatgttgtgcaatatccatctactgtagttaagatattcagtagtttgtttttcataagcatgtaattgatcatatttctgccaaggatgtgccttcaactttataattatagtgttgtaaaata

SEQ ID NO: 2796 - DNA, 5226 bp, Homo sapiens
agaaatcaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaagtaagtgccaagaatttatgtttctgtgttcttacctatttaatcagcactcccgtgaatcatttctggtttgcatcagatagaggcaatgaaaaaaaatctaactcctttgaacacttcaaacaagatctgtctcaaaatttaatgtaaacgtgtctgcatttttttttttggtctttttcaggaaaagttaggcaaaggtacatttacactattaatcaggagcaaacaagttagaaccacaaaacacttaaaatatttagaaaatggaaataaagtataatttgttataaataagattcatattagttactaagaaagtgaaggatcctgcttgatggctttttgtttgttaggtcaaaacaaaagacctatttttaagttaaagtaagaaatttaaaagactaaacccagctggacatagtggctcatgcctataatctcagcattttgagaggcctagagggcacaatcacttgaggccaggagttcaagaccatcctgggcaatgtagcgagaccctgtctctgcaacaaaaattaaaataactagccaggtgtggtgccacgcacccatagtattaatcacacgagaagcagaggtaggaggattgcttaagtccaggagttgaaggttactgtgagagagaccttgtctctaaaacaaacaaacaaacaaacacaatcctttctttgtgacagattcatcctgtgttcttcaataagtcttaagtggtaatacatgtgaatgtattttaaaagtttcagtatgctatagaattggtgttcaagtgatttaaagcattttattagttcagttaagatcctatttgtatagatgacattatcattaccatttttgtgaaactagttttactgagtacctgctatgtgccagttaccaagattgcaaagcttcaacccttaattcccacagcaatgtggtcatattcattttggaggtgaggaaacccaggttaagagaagttaagttacttatccaaagtcacatagctaataactgtcataactgggatttgagcctaattactctgactccaaaagctcatgcttgttctattcactgtgcactgccaacaaatgtaagatggcagcatttcccctagcagttggaaatgtaatgtgtattactatctatggtcagataagtcttgcttaggggtagtttcctttttatactttgttttattggggaaaatgatttttgttcatgttctttttctgataaaacaagactaaatactgcatatgcaaggccttgaataatatgtttagtatggtgctagcttttttttttttttttttttttttttggagacagagtctcactctgtcgcctgggctggagtgcagtggtgcgatctcagctcactgcaacctccgcctcctgggttcaagcgattctcctgtctcagcttcccgagcagctgggattacaggcacctgccactatttccagctaattttttgtatttttagtagagacggggtttcaccgtgttggccatactgctctcgaactcctgactttgtgatttgcccaccttggcctcccaaagtgctgggattacaggcatgagccaccgtgcccggcctggtgctagcttttatggcctattaatgagaacctctactgaggacagttgtacttgagttaaactcttatatataggatacatattaactagcattaaggaaatatttatttgtttgatgaaagattggaaacaaatgcaatcaagagcaggaagcacatcttcatctttgtattccccagagtgacttgccctcagtaattgaactgttcttaatgacaataccatggcttagaatttctctatacaatatttatatgttcagtgaaataatttttttctcatgaatttccttagagcttaggttttgaagcttctttggtcaagaaggatcggtcagcaagtcacttagatcataaacgagaaataagacagtaagtactttggagtgtcagtaaaaaacagattttgactccttattacaaatttttttttgcatgtcagtttttataatatcatccttatactggatgaaatggtcacaatgtatatctctctgtagtatgtagaatctttacccattagctatttatgaccatgatttttctttttttattttttccatataagatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacaggcaagtgaattgttagcaaatatatttgttaataataaaaaataagcaaaatttggcaggcaaggtttattttcagctacaaaactgatgttagctagaagtctgatcattttatgccatatgctttacaaaaataatcttcaactgggtagttatttaagttgataatagatgccatttaacccctaagaaagagttcaagttttttgggtttggtatttatatctgctactgtatataactttattttatttttaaatttttatttatctatttttttttttttagagatggggttttgctctgtcacccaggctggaatgcagtggtgtaagcacagctcactgtggtcttgaactcctgggctcaagcattccttctgcctcagcattctgagtagctgggacttccaggcactagccactgcacccagctcaatgactttatttttgttatttcttcctggcacttcagttcattactttctgtatgttttaaactcttttttcgagataaacttttactttggaatagaatacttctatcaaataaatcttttcctttatctgatccttataaaaggcaataatgattttaaaaaacatcttagtttctctgttttaatgaaataagctttccagttatatttaccaacaaaaacggccaacagatttcgtagcttgtgatataccagttagtttgagttttggaaagatgggtgagttttatacaaaaaaatccttgagaaaatgtaattcctttcttagttcttgtttttgctagcctcagaaagaaaaatctgcttggtgtgatggctcatgcctataatcccagctacttgggaggctgaggcaggaggattgcttgaggccaggagtttgagaccagcctgggcaacatatcaagactgtctctt

SEQ ID NO: 2797 - DNA, 4775 bp, Homo sapiens
actgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaaagcttaggttttgaagcttctttggtcaagaaggatcggtcagcaagtcacttagatcataaacgagaaataagacaatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaagggcaaaacatcagaggctcttgcaaagttaatttcactacaagctacagaagcaactattgtaactcttgattctgataatatcctcctcagtgaagaacaagtggatgtggaacttgtacaacgtggagatatcattaaagtagttccaggaggcaaatttccagtggatggtcgtgttattgaaggacattctatggtagatgagtccctcatcacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggctcctatccagcagtttgcagacaaactcagtggctattttgttccttttattgtttttgtttccattgccaccctcttggtatggattgtaattggatttctgaattttgaaattgtggaaacctactttcctggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaaatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatgatgagctgtgtggcttgatagccattgcagacacagtgaagcctgaagcagaactggctatccatattctgaaatctatgggcttagaagtagttctgatgactggagacaacagtaaaacagctagatctattgcttctcaggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataaggaatgatcttctggatgtagtggcaagtattgacttatcaagagagacagtcaagaggattcggataaattttgtctttgctctaatttataatctggttggaattcccatagctgctggagtttttatgcccattggtttggttttgcagccctggatgggatctgcagcaatggctgcttcatctgtttctgtagtactttcttctctcttccttaaactttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttg

SEQ ID NO: 2798 - DNA, 2716 bp, Homo sapiens
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccccacacaactatgtctggtcaccagctccctcctgctggcacccagagacccggacccgcagcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatg

SEQ ID NO: 2799 - DNA, 2605 bp, Homo sapiens
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttgtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatg

SEQ ID NO: 2800 - DNA, 2614 bp, Homo sapiens
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttgtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaagatta

SEQ ID NO: 2801 - DNA, 2722 bp, Homo sapiens
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaa

SEQ ID NO: 2802 - DNA, 1764 bp, Homo sapiens
gctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccagcgcttcaccccaaggcaagaccctaacctgggccctaacctggacggagggagggaaagggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaag

SEQ ID NO: 2803 - DNA, 1666 bp, Homo sapiens
atgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatg

SEQ ID NO: 2804 - DNA, 1080 bp, Homo sapiens
gcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgca

SEQ ID NO: 2805 - DNA, 1588 bp, Homo sapiens
cctgttgtaagcccgcagctttgggcctggtctctgctgctcccaggcggcccctttgggtactgcctgagcaagaagtgctggagaggaggaccagtcatcaataggaggatgagattgggagagacactcggtgcaggaggctgagtgagcaggggagcactaagacccaggggtagtggaggactgcagcaacgagctggaggaggagaagtaagcggtggggggtgggagccatctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 2806 - DNA, 1261 bp, Homo sapiens
ggagaagtaagcggtggggggtgggagccatctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 2807 - DNA, 1351 bp, Homo sapiens
tctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 2808 - DNA, 609 bp, Homo sapiens
ggcgggcagcagcatgcagtgccgtgtccccatggcggtcctggtgggcagggtcagccccgagccgaagcagcaggcacagggcaggggcatcgtggcgggcacaggcccggtgcagtggtgggggctgcccagcatctacatcgaggcctgggtgtcgctggaggagggcctgggcccggaccagccgtcctgcagacaaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataatt

SEQ ID NO: 2809 - DNA, 1261 bp, Homo sapiens; identical to SEQ ID NO: 2806

SEQ ID NO: 2810 - DNA, 1261 bp, Homo sapiens; identical to SEQ ID NO: 2806

SEQ ID NO: 2811 - DNA, 1351 bp, Homo sapiens
tctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcagagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 2812 - DNA, 1261 bp, Homo sapiens
ggagaagtaagcggtggggggtgggagccatctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcagagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 2813 - DNA, 1351 bp, Homo sapiens; identical to SEQ ID NO: 2807

SEQ ID NO: 2814 - DNA, 1261 bp, Homo sapiens; identical to SEQ ID NO: 2806

SEQ ID NO: 2815 - DNA, 1261 bp, Homo sapiens; identical to SEQ ID NO: 2806

SEQ ID NO: 2816 - DNA, 1351 bp, Homo sapiens; identical to SEQ ID NO: 2807

SEQ ID NO: 2817 - DNA, 1261 bp, Homo sapiens; identical to SEQ ID NO: 2806

SEQ ID NO: 2818 - DNA, 1351 bp, Homo sapiens; identical to SEQ ID NO: 2807

SEQ ID NO: 2819 - DNA, 1351 bp, Homo sapiens; identical to SEQ ID NO: 2807

SEQ ID NO: 2820 - DNA, 662 bp, Homo sapiens
ctaacctgttgtaagcccgcagctttgggcctggtctctgctgctcccaggcggcccctttgggtactgcctgagcaagaagtgctggagaggaggaccagtcatcaataggaggatgagattgggagagacactcggtgcaggaggctgagtgagcaggggagcactaagacccaggggtagtggaggactgcagcaacgagctggaggaggagaaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaa

SEQ ID NO: 2821 - DNA, 1294 bp, Homo sapiens
gtggaaccaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 2822 - DNA, 1175 bp, Homo sapiens
acgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 2823 - DNA, 944 bp, Homo sapiens
gggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtct

SEQ ID NO: 2824 - DNA, 370 bp, Homo sapiens
gtgggcagtggggctgccctggccgatgctcagaaccccagcctctttgtaaagattctcatcgtggagatctttggcagcttggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtccccca

SEQ ID NO: 2825 - DNA, 865 bp, Homo sapiens
cgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtg

SEQ ID NO: 2826 - DNA, 1298 bp, Homo sapiens
acaggctaggacgcacggctgccagagaggacgccttaggggcccgcgagcaggctcgggaataaaacagggctggcagggcgaggtggagagactcgagaaggaccggccagatgtcgaagttcctagagaggagggcgcccaagcctccgccgagacgcgtgactacaactaccacaatccccagcgcctgcggttccagcgtcgccttgctctagacgggcggcggcgctgcgcggggaaccggcgtggggtcacgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtc

SEQ ID NO: 2827 - DNA, 411 bp, Homo sapiens
acgcgcttccctgccactgggttagggaaggcttgccggaaggacgatttcggaggacagcaggtgttagccaggcagcggagcgagcgccaacaggcgcactggggcggagagacgccgtgagcaaggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgca

SEQ ID NO: 2828 - DNA, 825 bp, Homo sapiens
gagctgaactgctttcttctctgcttccacaacaggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 2829 - DNA, 1685 bp, Homo sapiens
tgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgca

SEQ ID NO: 2830 - DNA, 1402 bp, Homo sapiens
tcccattggctgagaagggtcatgaggatgaactgtgcagtcacctggcaggaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactacaaa

SEQ ID NO: 2831 - DNA, 1208 bp, Homo sapiens
aaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacaggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcgga

SEQ ID NO: 2832 - DNA, 994 bp, Homo sapiens
ataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggc

SEQ ID NO: 2833 - DNA, 1716 bp, Homo sapiens
agagccacgcccccttatggtcacgtgaggcgcttgcgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaa

SEQ ID NO: 2834 - DNA, 1254 bp, Homo sapiens
cctgcacttcaagggcttctctctccggcagcctgtggacttccctggagcacttgctggagcagagatcacaggaaggtcactctggccagcaagtagcactgttagaccagtcaagggctgaggaatggatggtgccacaagggatgccagagggacttgtccctgagtgatgacagtccagtgacagtgctgatggtccatgcctgtcagacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtc

SEQ ID NO: 2835 - DNA, 1262 bp, Homo sapiens
gttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacgcaggagtcagaggctgggacacctgaagggccagggaacatgcccaagctaggaagcaggccctctcctggccacaggcctcctttcctgagagtctccttgctgccctggcctccatcaagttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtg

SEQ ID NO: 2836 - DNA, 5612 bp, Homo sapiens
gctgggctggcacgtgacttgttctgtgttcgcttgggtagaggaagccgtgaggccggagcttaggtcgggaagggatggatcgctgagccgatagcgtccgctaggctgtctgcctcgaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttacgccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaatttagtgtcctgaaagagcttttaaaagaggattttgtggcaatgtttctcttactacgtactcacaggtttgcaaatgggaaaaaagtttacatttcagtttaggggcatatctaagctatgctattccctttagaaaattagcctccaaaatcttttgtttcaaaatattatattatttcataaataatttcaagcaaatacagacatccacaatgtagaacatgagagaccccctccctcaatttccacctcccaagggaagtttatgtatttttctaggcccttttctatgtctttacatctctgtctcacacacacacacgtatacacacacacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaatttgggaaaatccagatccacatcattgtagagtctgagggttagaaggaagtcattgtgtctaacataacaacagagcagtttgtgtcactgagctccagtctgtgctggattattgatattgttggtggcggtcaccattcctggaaagggactgtcccaagccacttaccttcccgaggagtctgctggttctccttgaggatagtgcttagataacagactcattaaacatttactgagtgtctgtcagggatcattcacatccacatcatcctcccggcccctccccgtgttgttcatggagggagtactggcggtccccattttcatgtatggagacttcaggtgaaagaagttaagtgaattctttgttgagtcacaaatcttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctagagtgcagtggcatgatcagggcttactgcagcctcaccctcgatttcctgggctcaagcaatcctcccacctcagcccccaagtagctgggcctacaggtgcgtgctaccacgcctggccaattttttaaattttagcacagatgaggtctcactatgttgcccgggctggtctcgaactcctgagctcaagggatcctcccgcctcagcctcccaaagtgctggtgttacaggcataagccaccacgcctggcctgtgttgctattatatttggcaggaacccagagtccagaacatttcatctatgatgggttagataatgtgtctagttgtttgcatgccaatttcagtagcctcagttattcaacctaggagatttttctacctctttactaccctgctgaagttgctcttcagcagaaaatctttgtggaacacattccacactttgaaatcttcgtggaacaaaagatatttgtggaaccaatctttgtggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagatatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctataaatggtattatgttctggaggaaacctagcaaaaactttgctagtttagtacttgtctctaaattgatgttcacccatttcaatattgcacttattaatggtctttatttttctagcatagataacaattgattctttagattcatatatggaggtaattcttgctttctaaagaaaggaatatggcacattggaaccattttattcaccagtggatttacccttagagtatttttagatctgagctgatgacttgtgagagaaaaagggaacagagtaaagccatggaagccatgaacagtaagagactgccgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgctcattaccaa

SEQ ID NO: 2837 - DNA, 2130 bp, Homo sapiens
agaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttacgccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatg

SEQ ID NO: 2838 - DNA, 2093 bp, Homo sapiens
gtggagaaagcggcagctgtcccagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 2839 - DNA, 728 bp, Homo sapiens
gtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaat

SEQ ID NO: 2840 - DNA, 609 bp, Homo sapiens
gagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatcta

SEQ ID NO: 2841 - DNA, 777 bp, Homo sapiens
gtgtcccgccggcccgttccgtgtcgccccgcagtgctgcggccgccgcggcaccatggctgtgtttgtcgtgctcctggcgttggtggcgggacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaac

SEQ ID NO: 2842 - DNA, 1511 bp, Homo sapiens
gtaactggtgattggtggagaaagcggcagctgtcccagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcata

SEQ ID NO: 2843 - DNA, 1006 bp, Homo sapiens
gtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttat

SEQ ID NO: 2844 - DNA, 1030 bp, Homo sapiens
acgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccag

SEQ ID NO: 2845 - DNA, 1311 bp, Homo sapiens
gagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgt

SEQ ID NO: 2846 - DNA, 4142 bp, Homo sapiens
ggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgaggctgaattgcatcatcagcagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccgg

SEQ ID NO: 2847 - DNA, 4139 bp, Homo sapiens
ggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagccttccgaggacgaagtgtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccgg

SEQ ID NO: 2848 - DNA, 3028 bp, Homo sapiens
ggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcac

SEQ ID NO: 2849 - DNA, 2774 bp, Homo sapiens
acgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcct

SEQ ID NO: 2850 - DNA, 3047 bp, Homo sapiens
cggagggtgcgggtttggctgcggtggtttctgtggcggttgctgtggcggagtttggaggttggagagaaatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagccttccgaggacgaagtgtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccgg

SEQ ID NO: 2851 - DNA, 3046 bp, Homo sapiens
ggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagccttccacctcgggacagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcac

SEQ ID NO: 2852 - DNA, 5789 bp, Homo sapiens
gggggcggaaccggaaccggcagtggcttgggggcgggacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgcgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagtgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcgagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcatcaccttcccgtttttatttgctgtgatgtttggagacttcggacatggctttgtgatgtttttatttgccctcttgttggtgttaaatgaaaatcatcccagactaaatcagtcacaagagatcatgaggatgttttttaatggccggtacatcctcctgctgatggggctgttctcagtgtacactggcctcatctacaacgactgcttttcaaagtcagtcaacctgttcggctctgggtggaacgtgtcggccatgtacagctccagccacccacccgcagagcataagaagatggtgctttggaatgacagcgtcgttagacacaacagcattttgcagctggatccaagcattcctggagtgttccgaggcccttatccccttggcattgatcctatttggaacttggccacaaatcgcctcacttttctaaactctttcaaaatgaaaatgtccgtgattttaggaatcattcatatgacttttggagtcattctgggaatatttaaccacttgcacttcaggaagaagttcaacatttacctggtttccatcccggaacttctcttcatgctctgtatctttggataccttatatttatgattttctacaagtggctggttttttcagcagaaacctccagagttgctcccagcattctgattgaatttattaacatgtttttattcccagccagtaaaacaagtggcctttacacagggcaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgagatataaaaatttcttttggttttttatgatgagcaaatataagttaatgccaaacgttatgttaaagttattttttcaaatacaggatttggggagagaagccaattttgcatggctagttgaaaatggtattagatacttatttcctttaaactttatttaaaacaaacaacagagttaatctgtcacctgaagttgccagataatattttccaacagctgaagtagggatagttttttaaaaaatttaatgatgggtaatcaaaacattcacatttattctgctggatttaaaaatatgtactttttttttttttttgagatgaagtcttgctgtgtcacgtaggctggagtgcaatggcacgatcgtgtctcattgcaacttccgcctcctggattcaggtgattctcctgtctcagcctcccgagtaactgggattacaggcatgcgccaccgtgaccagctaatttttttgtatttttgtagagatggggtttcaccatgttggccaggctggtctcgaacttctgacctcaagtgatccacctgcctcggcctccctaagtgctgggattacaggcgtgagccaccatgcctggccaaaatatgcaaatattttttatcctgtgctacctagaattacaagtagaggattgtttttacaattttgtcttgttttagtaattggggacaatgggataaaatgacatacaacaaatggttatcccacttgtatatttttttaaagactcttatcctgttacccttacataaaaccagttatgataattgtatgtttggaagataaattgtatgctgagccttaaaacccagtgtgactgtagaagatataatgcggacatgatttgaatttagtgacagcttggctgatgtcactgaaccagaagggtttatactgagtgaaggaaaggtaaaaagtagtattttgtatatttttgtaacaaaatataaatgaagatattttaccatgaagagattgcacttatccttgagaacagtctaaatataaatgaagatattttaccatgaagagattgcacttatccttgagaacagtctaatgatactttttttactttcagactgtttctagctaaagttctgataaaagtattgagttaatttaaactttcaaacactgtttagatcagttgaaaactaattcttaatagccattgttttataatctttagtttaaattcatctgtttgacatttggttttttgtgaacttgagtcagtcctattgaacattttgacctatattcttgcaaattatgttaatttttcatattttagtttgattttagacaattattttcaaaaagaaacctgactttttttcaccttcttgacattgtgagtgatacacgttaaaaggctatttgcccgcatcctcctctatcctgtttcgaggtagagagcttggcacttctgttacaagctgagagtctggaggtgctgagtttaacgtggctgtgcagctgatttcaaggcatgagctgaacagcgttgacacagccgtgacttacaattaaaccctttcaattacagtacagattctgtgtgctacttgatgagatgttacccaaggccagtttggacttactgctttttgtccctcatattaaattatcaaatgatgccgatgaaatgcttgaaaatgattctgctctcaaagttatgcttccctagaaaggtgtcatgtcgggcacttgtgttgggtgactatgacatcccagcagtgctggtcaggtctcagagttgctttcacctagagctgatgcttccacaaggggacatttgtgttactttgctccaggggtctgtcataaaaacaatggtaactacttcatccctaggaagcccaagacttcagggcactgttagctgattggtaaataagggacacgatattcacgggaattgtttactgctccccactagtaattctcatggggccacttttttaactctttctaattaacacctcttctcagcatagagcagaggatgcagtcatttctctgttgaaatctatgtagtatttatgtagaatgtcattatatgaaaagcgaattcagaatcctaactctgggaaagcgctctctggaaatgtagtttgataatagtgtcttataggggccacgggaatttgtttctctataaagcgatgggctccagtgtcatgttaccagagttatcgctcagttttgtttgttaaggcttttgctagaacctattatgtatccagtttttaaaacatacttcattcccttgatagcagagatccagagcacagatggcaagttgtgtggatgatactgaatatgtttattttcctaaagataaatgtcacgacacgacatttctcagtttttatttagatgtttattaccatgtgttaacagaatcttaaaacccaagggatttcttcagtaaactagactttgattcaacctgctgggctggagactgtaattgccgtggtcagttaaggagtgcaaagggtgttctgtctgataggatctgggtgagccctgcggactttccagcagcgaaaggacttggaactcctctttcgctgaatgctgctctgtttctggaatggatattttataacaacattctggtgtcagcatcccctcagcagttgtttatttaaaaatttttttattttttttgagacagtgtctcactctgtcacctaggctgaagtgcagtggtgcagtctcggctcactgcaacctctgcctcctggg

SEQ ID NO: 2853 - DNA, 1620 bp, Homo sapiens
acctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgcgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagtgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcggtaaggctgccttcctctcctctgccaggaacagaagagagactgatggaactgataaattcagagaaaaaaaggaagtgagaatttcatagagtaatgagaatgcagtgtgttgactcttcttttgtttttttaaaatattaattaacaaaattaaaatagagatggggttttgctgtgttgcccaggctggtctcaaactcctggccccgagcgatcctcctgcctcagccttggctctgtttttgaactgaaattatggtgagctggtcattcaaagctgtatgtgagtacatgtgtttttaaattgctcttttgagtaattcattcacatggtgtaaaagtgaaaagaaataaaagagtatgaaagac

SEQ ID NO: 2854 - DNA, 3135 bp, Homo sapiens
ataacgctacctgccgagcaagccgagtggagggaggcaaaggccaggctgaggatcagggtggcccgggtggcagcggggaggcgctgcatgctggaggctgtgctgagtgcccggtgcaggtgagccggtcctgcggagttgtgccgagtgcctgctgcagtctcatttccagttcctccatgacgtggcaagtgaagacaggaatgaaaggaatgtaaagcagcttttctctgaagagaagaagagagagagacacagccaagaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattc

SEQ ID NO: 2855 - DNA, 2709 bp, Homo sapiens
gctggaggctgtgctgagtgcccggtgcaggtgagccggtcctgcggagttgtgccgagtgcctgctgcagaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggtt

SEQ ID NO: 2856 - DNA, 3090 bp, Homo sapiens
aacagagctgcctcctggctctttgggagcctgggaggagaaggagccgggaggggcgctgcggggaagccacctgcggattcactggctgctgctccgcccaggactgctagcaagcacggagggctgccagacctggggctccctgctccgtgcgtcaggttggggaaaccaccgtctgccccagaccctgacccaggacccgcctggaggaagctgggaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattc

SEQ ID NO: 2857 - DNA, 3558 bp, Homo sapiens
gttgggtgggagcacaggcaccgggcaccatggggaaggccgagaactatgagctctactcggtggagctgggtcctggccctggcggggacatggctgccaagatgagcaagaagaagaaggcgggtggcgggggtggcaagaggaaggagaagctggagaacatgaagaaggagatggagattaacgaccaccagctgtcagtggcggagctggaacagaaataccagaccagtgccaccaagggcctctctgcgagcctggctgctgagctgctgctgcgggatgggcccaacgcactgcggccaccacggggcaccccagagtacgtcaagttcgcgaggcagctggccgggggcctgcagtgcctcatgtgggttgccgccgccatctgcctcatcgcctttgccatccaggctagtgagggggacctcaccaccgacgacaatctgtacctggcaatcgctctcattgctgtggttgtcgtcaccggctgctttggctactaccaggaattcaagagcaccaacatcatcgccagctttaagaaccttgtgccacagcaagccactgtcatccgcgatggagacaaattccagatcaacgctgaccaactggtggtgggcgacctggtggagatgaaaggtggggacagagtgcccgccgacatccgcatcctggcggcccagggctgcaaggtggacaactcctcgctgacaggggagtctgagccacagacccgctcacccgagtgcacgcacgagagccctctggagacccgcaacatcgccttcttctccaccatgtgccttgagggcaccgtgcagggcctggtggtgaacacgggcgaccgcaccatcattgggcgcatcgcatcgctggcgtcgggggtggaaaacgagaagacacccatcgctatcgagatcgagcattttgtggacatcatcgcgggcctggccattctcttcggtgccacattttttattgtggccatgtgcattggctacaccttcctgcgggccatggtcttcttcatggccatcgtggtggcctatgtgcctgaggggctgctggccactgtcacagtctgcctgtccctgacagccaagcgcctggccagtaagaactgcgtggtcaagaacctggaggcggtggagacattgggctccacttcggtgatctgctcggacaagacagggactctcactcagaaccgcatgactgtgtcccatctgtggtttgacaaccacatccacacagctgacaccacggaagaccagtcagggcagacgtttgaccagtcctcggagacgtggcgggcgctgtgccgggtgctcaccctgtgcaaccgcgccgccttcaagtccggccaggatgcagtgcctgtgcccaagcgcatcgtgattggagacgcatcggagacggcgctgctcaagttctcggagctgacgctgggcaacgccatgggctaccgggaccgcttcccaaaagtctgcgagatacccttcaactccaccaacaagttccagctgtccatccatacgctggaggacccgcgggacccgcgacacttgctggtgatgaagggcgcccccgagcgcgtgctggagcgctgcagctccatccttatcaagggccaggagctgccgctggacgagcagtggcgcgaggccttccagaccgcctacctcagcctgggaggcctgggcgaacgcgtgctcggcttctgccagctctacctgaatgagaaggactacccgcctggctatgccttcgacgtagaggccatgaactttccatctagcggcctctgctttgcgggacttgtatccatgattgacccaccccgggccaccgtccctgatgctgtgctcaagtgtcgcaccgcaggcatccgggtgatcatggtaacgggtgaccaccccatcaccgccaaggccattgcagccagtgtgggcatcatctcggaaggcagcgagacagtggaggacatcgctgcccgcctccgtgtgcccgtagaccaggttaatcgcaaggatgcccgtgcctgtgtgatcaatggcatgcagctgaaggacatggacccatcggaactggtcgaggccctgcgcacccaccccgagatggtgtttgcgcgcaccagcccccagcagaagctggtgatcgtggagagctgccagcggctgggtgcgattgtggccgtcacgggggatggtgtgaatgactccccagctctgaagaaggcagacatcggagtagccatgggcatcgctggctcagatgctgccaaaaatgcagctgacatgatcctgctggatgacaactttgcctccattgtgacaggcgtggagcagggtcgactgatcttcgacaacctgaagaagtctattgcctacacattgaccaagaacatcccagagctgacaccctacctcatctacatcaccgtcagcgtgcccctgcccctcgggtgcatcaccatcctcttcatcgaactctgcactgacattttcccatctgtgtccctggcatatgaaaaggccgagagtgacatcatgcacctgcgtccacgcaacccaaagcgtgacagattggtcaacgagcccctggctgcctactcctacttccagattggtgccattcagtcctttgctggcttcactgactacttcacggcaatggcccaggagggctggttcccactgctgtgcgtggggctgcgggcgcagtgggaggaccaccacctacaagatctgcaggacagctacggccaggagtggacattcgggcagcgcctgtaccagcagtacacctgctacaccgtgttcttcatcagcattgaggtgtgccagatcgccgatgtcctcatccgcaagacgcgccgtctctctgccttccagcaaggcttcttcaggaataagatcctggtgatcgccatcgtgttccaggtctgcatcggctgcttcctgtgctactgccccggcatgcccaacatcttcaacttcatgcccattcggttccagtggtggctggtccccctgccctacggcatcctcatcttcgtctatgatgagatccggaagcttggagttcgctgttgcccagggagctggtgggaccaggaactctactattagagggacgactgccttcaagcatccctgcaactgccacagcaggtgggggcagggctcgtgggaccctctggacagccaccaagatatctgagcaaccaagagtcccagccccaccagtatctgcttctgtagcccacggcaccccaaacttggagggacctgcccactcccctcccccattcccaaggttcgcacctcctggagcagcagcgcctgggcagtcctctgggctggcctcgggaaagccgccacctgtggtggcggtggggctctgacagggagtacagctgaccgcttctggagggtgtttctgttcttaggactccagtccaggctggacggctgcctgagggcccttcgttaaagacacgcttgtgtcctgggcgatggtaataaaaccagctcatgctgactgtgctgt

SEQ ID NO: 2858 - DNA, 1434 bp, Homo sapiens
gagggtgcagggagcagacgggaggatctcaggccagggacgatggcggctctgcaggagaagaagacgtgtggccagcgcatggaggagttccagcgttactgctggaacccggacacggggcagatgctgggccgcaccctgtccaggtgggtgtggatcagcctgtactacgtggccttctacgtggtgatgactgggctcttcgccctgtgcctctatgtgctgatgcagacagtggacccgtacacaccggactaccaagaccagctacggtcaccaggggtaaccttaaggccggatgtttacggggagaaaggcctggaaattgtctacaacgtctctgataacagaacctgggcagacctcacacagactctccacgccttcctagcaggctactctccagcagcccaggaggacagcatcaactgcacctccgagcagtacttcttccaggagagtttccgcgctcccaaccacaccaagttctcctgcaagttcacggcagatatgctgcagaactgctcaggcctggcggatcccaacttcggctttgaagaaggaaagccatgttttattattaaaatgaacaggatcgtcaagttcctccccagcaacggctcggcccccagagtggactgcgccttcctggaccagccccgcgagctcggccagccgctgcaggtcaagtactaccctcccaacggcaccttcagtctgcactacttcccttattacgggaagaaagcccagccccactacagcaaccccctggtggcagcgaagctcctcaacatccccaggaacgctgaggtcgccatcgtgtgcaaggtcatggcggagcacgtgaccttcaacaatccccacgacccgtatgaagggaaagtggagttcaaactcaagattgagaagtgaaacggtttgcgcaggggtcctgggcacgcctgcggggtcgctcaaggacaccctcctggttgggcttaccttgcccgtcagttccctgccaaatcatccccaaagtggtttggagcaacggtgttgtcagtgtgcgaactccagagaagcgcccacatctgaaggacctgctcgcgagtatcagttcttccttgttgaattcttacagtttttagatggaatttgctgctataagaatgtccagctaccatgggaacgcaaggcagcaactctctaattaaccaggtcataaaaacgattcgtcttctatgtagacatcactttcttactataatttatttttctacacttcaatatgaactgccccccccacattaatataaaaactactaatgcactgatatgaaacacggcttacactaatgacattctgaattcttgcttttaaaattgcaattcctaagttgtaaacataaaatatattaaagttactcttattgtatgtaaaaaaagaaa

SEQ ID NO: 2859 - DNA, 3732 bp, Homo sapiens
aatcctggactctcccgacccctagctgtcggtccccctccctgcgcgcgcgccggcgggtttcctaccctccgaggcgtccgctggcctgcgccctggcggggacgtgggcggggcgggcggcatttaaggctggtgccacctccccggtgcagcggctggcgatcggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggatgaccacaaactcagcaatagggaattggaagagaaatatggcacagacatcattatgggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtgtacttgggctgtgtgcttggtctggtggtcattttaacggggatctttgcttattaccaagaggcaaaaagcaccaacatcatgtccagcttcaataagatgatccctcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtggataactcatctctcacgggggagtctgagccccagccccgctcctctgagtttacccatgaaaaccccctggaaacaaagaacatctgcttctattccacaacgtgtctggaagcatctacttcccctgtaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaaaccaagtctttgaccaaagctctaggacttgggcctccttatccaagataataacattgtgtaaccgagcagagttcaagccaggacaggaaaatgtccccatcatgaagaaagctgtgattggagatgcctcagaaactgctcttttaaaattctcagaggtcattttgggtgatgtgatggaaattagaaaaagaaaccgcaaagtagctgaaatcccttttaactctactaataaatttcagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggttattatggttactggtgatcatcccatcacagccaaagctattgccaagagtgtggggatcatttcagccaacagtgaaacagtggaagacattgcacatcgcctcaacattgctgtggagcaagttaacaaacgggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattatcccctccattgccttggcgtacgagaaagctgaaagtgacatcatgaacaggaagcctcgccacaagaataaggacaggctggtgaaccagccgctcgctgtgtactcatacctgcacattggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatggacaaggtaccagagggaatacctagaatggacgggctacacggctttctttgttggcatcctagtccagcaaatagcagatctgatcatcaggaaaacccggaggaattccatcttccagcagggtctcttcagaaataaagtcatctgggtggggatcacctcacagatcatcattggtctgatcctctcctatggcctcggaagtgtcacagccttgagtttcaccatgcttagggctcagtactggtttgtggctgtgccgcacgccatcctgatctgggtgtatgatgaggtgcggaagctcttcatcaggctctaccctggaagctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtataggg

SEQ ID NO: 2860 - DNA, 3538 bp, Homo sapiens
cggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggatgaccacaaactcagcaatagggaattggaagagaaatatggcacagacatcattatgggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtgtacttgggctgtgtgcttggtctggtggtcattttaacggggatctttgcttattaccaagaggcaaaaagcaccaacatcatgtccagcttcaataagatgatccctcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtggataactcatctctcacgggggagtctgagccccagccccgctcctctgagtttacccatgaaaaccccctggaaacaaagaacatctgcttctattccacaacgtgtctggaaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaaaccaagtctttgaccaaagctctaggacttgggcctccttatccaagataataacattgtgtaaccgagcagagttcaagccaggacaggaaaatgtccccatcatgaagaaagctgtgattggagatgcctcagaaactgctcttttaaaattctcagaggtcattttgggtgatgtgatggaaattagaaaaagaaaccgcaaagtagctgaaatcccttttaactctactaataaatttcagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggttattatggttactggtgatcatcccatcacagccaaagctattgccaagagtgtggggatcatttcagccaacagtgaaacagtggaagacattgcacatcgcctcaacattgctgtggagcaagttaacaaacgggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattatcccctccattgccttggcgtacgagaaagctgaaagtgacatcatgaacaggaagcctcgccacaagaataaggacaggctggtgaaccagccgctcgctgtgtactcatacctgcacattggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatggacaaggtaccagagggaatacctagaatggacgggctacacggctttctttgttggcatcctagtccagcaaatagcagatctgatcatcaggaaaacccggaggaattccatcttccagcagggtctcttcagaaataaagtcatctgggtggggatcacctcacagatcatcattggtctgatcctctcctatggcctcggaagtgtcacagccttgagtttcaccatgcttagggctcagtactggtttgtggctgtgccgcacgccatcctgatctgggtgtatgatgaggtgcggaagctcttcatcaggctctaccctggaagctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaa

SEQ ID NO: 2861 - DNA, 3654 bp, Homo sapiens
ctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaa

SEQ ID NO: 2862 - DNA, 2595 bp, Homo sapiens
ggtaaagaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgaacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatgg

SEQ ID NO: 2863 - DNA, 698 bp, Homo sapiens
caagagctgtaccgaaagaggcaccaacaaatgtggttgctccataatggagagaatgtcaagaatgttgactatctttagacctgcttcattaatagataagatagaaactaaagaacccacccagttggaagaagttattagtcaagtagtgctgcacacgtgaccacagaagttaaaaaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtga

SEQ ID NO: 2864 - DNA, 3572 bp, Homo sapiens
gatatgtaataatgtctttgcaaagcaaagaatataaacagtataaaagtactagcatttagatgtattgtatcatttaatccttaaaaacatgaaatgaggttggcactattctttatctccacgctgtggaagaggaaattgaaatgtagaagttagtaacttgcctaaggatacactgctggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatgg

SEQ ID NO: 2865 - DNA, 654 bp, Homo sapiens
agcgcccggggaggccatccgcaggtgggcgcggggcctggattccacagaggggcggagtccctcagtcaggcgctggctgcaatcacacccgagcgccagccccctccagcatccctgagtcccagaggagatcgccgaagcgctggaaaagccgttccgcccacgacttctggtgccgggtcggcggcgactgggggagcccagttccgagaccgtaccgcacccactgcggacctcctgggccctacatagttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcag

SEQ ID NO: 2866 - DNA, 579 bp, Homo sapiens
agacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaagactctgacgcagtacagttaatctgtgcacaggaaagaagagctgtttgaagaggttattcggtaaatgcagagaatgtctttgtagtataaattattgctctatataaaactgcttgtaagtttt

SEQ ID NO: 2867 - DNA, 3225 bp, Homo sapiens
ctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaagactctgacgcagtacagttaa

SEQ ID NO: 2868 - DNA, 3763 bp, Homo sapiens
agcagcgggggcggccccgggactgagccggcatccctgagcctggctcccctccctgcgaccgccgtcacctccttctccttccttttccctccgccctccgtgccctgaggaaaggcgcgctcctccccttcccctggggcgctccgccggggcctcctcccgggcctccgttcccgccgcggccccggttccggcgggggcagcctccgggttcggggctccttctcctggggacgctggggcttagcttgctccgcgcagaggcggccgccctcccccaaagaaaaaactggctgcttctaagtgcgaagccggctgggcgggctggtgccagaaagggtgtgtcttcactgccctaagatggcctttaaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatgg

SEQ ID NO: 2869 - DNA, 5421 bp, Homo sapiens
gtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaa

SEQ ID NO: 2870 - DNA, 3338 bp, Homo sapiens
ccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaacctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtcc

SEQ ID NO: 2871 - DNA, 2308 bp, Homo sapiens
atgctcagctctgctctggccctctctggagctctagtcaaacgtcttaaaccccctaatgggcatttcatcttaacagatactcatgatctcaacacatctaaaattgaacattcattatttacagtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagca

SEQ ID NO: 2872 - DNA, 4413 bp, Homo sapiens
tccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaa

SEQ ID NO: 2873 - DNA, 945 bp, Homo sapiens
ctctgtctgccagggtctccgactgtcccagacgggctggtgtgggcttgggatcctcctggtgacctctcccgctaaggtccctcagccactctgccccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggtgattgggtgctccagagggggtggataggattagaggaggctgagggcagtggcgtggtggggtgagtggttgagataaaggctct

SEQ ID NO: 2874 - DNA, 3548 bp, Homo sapiens
ctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 2875 - DNA, 3418 bp, Homo sapiens
gtaggtgctgagccggctgggcgccgcttccgtgtgacattgtggggccggtgacattgggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagag

SEQ ID NO: 2876 - DNA, 3818 bp, Homo sapiens
gaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggtgagggagctcggcaaggcagccgaggggggcggggggcagcagggtctcaggcagctggtcccaggctcccctcgccctgctggatggctctgccacctggttcccactcttctctctcttcccatctctccgggcacccactctgtcttctcacgggtctctgtctgtgtggtttccttgtctctctccctctctgtccctctctctgctgggcggctcgccttgcctgtctctctccatctcttactctgtctctttctttccttctttgtctctccaggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 2877 - DNA, 598 bp, Homo sapiens
gcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatggggtctggtggctctgacagctatcgtatcgccacctcgcaggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggct

SEQ ID NO: 2878 - DNA, 2428 bp, Homo sapiens
ttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccccggctgatgccatctctggttctggacaattatcaaatatatcagtggggagag
